United States Patent 11,098,302 (IDENTIFICATION OF POLYNUCLEOTIDES ASSOCIATED WITH A SAMPLE) - sequence listing, part 21

SEQ ID NO: 68916 - DNA, 929 bp, Homo sapiens
  misc_feature: GYAE6OF01EF3A5.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccacgcccacctgtctgtcgtctcggaagggaancgcctacctctaccgtgaccgacgggacccaggtcgaggtagttggttacgacgacggtaccgtacgtttacgcccggtacgggttaaccaacggaccgtaaacggaaaacccgtcgggaacccgtacgggcccgttaccccggacgggttccccttaccccgttacctaacgttaccgttacgtacggtaacgttcgaccttaaccgtacccgaaaccggtaaccggggaccctaacgttacggtaaccttaaccgtaccccgtaaccggtaccggttaacgggttaccggtagggtaccgggtaacgtacgggggtttcggggtaccggttagggaacgtaacggttaccgtttaccgtaaccctttcctaacccggtaacctataccccgggtacggtaaccccgtacggtccccggttaaggtaccggttacggtttacgtaaacgggtttaacgttttaacgttttacggtaaactttttaaccttttaacgtttacgtttaaccgtacgtaacggtttaaacctaaggtttaaaagttaaacccgggttaacccggttacccggttaacccgttttaaccggttaaccgttttaccgggttaaccggggaacccgggtaaacggggttaacccgaaagggttccggttaaagggacgttaaacgtaaacccgggtaaagttccgggttacggtacggcccgttaaggaaccccgttgttaaccg

SEQ ID NO: 68917 - DNA, 714 bp, Homo sapiens
  misc_feature: GYAE6OF01BXX3Z.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccacgccaccctgtctgtcgtctccgaaggggaaanacgccaccctctcctgcgagggccagtcagtagtgttagcagcgtacttagccgtaggtaccagacgaacgaaaccgtggaccgacggcctacccgacggtccttcccgtactacttactagtgactcgtacctaacgtacccaaaccggaacgggaccctaacgttaggtaacttacctaccccggaacggtacccggttacggttaccgtagggtacgggtacggtacggggttcggggtacggtacggggaacgtaggttacgttaccaccgttacctaccgaacctacgtacacgaccgacggccctaggaccgtacgtcgtaaggttaatttacggtttacgaacgtttaattttacgttacttgtacgtaagtacgtaagttaactaacgttaccgtaccggttacccttacgttaccttcggtttacgggacgtacgggtaactacggtcgtaggtaacgtactaaaccgtaaaggtacggttgtacgtcgtacgaccgtacgtacg

SEQ ID NO: 68918 - DNA, 841 bp, Homo sapiens
  misc_feature: GYAE6OF01DZT7R.51.76.G10.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctacccagataccactggaagaagtagtgatggacgcagtcctaccacgccctaccctgtctgtcgtcgtaccggaaggggaacncgccctacccctctccnggacgacggccagtacgaggtagttgtacgacgacggtacgtacgtttacggcccgttaggaacccagtaccgaaacgaacccggtcggaccacggtccctacccgaggtcctaccccgtactactacgtactaggtaactccgtaccaaccgtaaccggaacggtaaccggaccctaagtagtaccctaccgacccgacgtacccgttaggttaccgacgggtagggacggtacgggtttcgggacgttacgggaatacggtcgttaccctacgtaccgtacccaaacgttccgtacgaccgtacggtacccgccgttacggaccgttacggttaacctaggtttaaacgtttactttaagtaacttttacgttttaaccgttacttacggtacgtaacgtaacgttaaacgttaacgttaaccgttaaaccgtttccggtaacccgtttaaccctttaccgggttttaccgggtttaaaccccggaaccgggttaaaccggggtaaacccgtaacggtaccgggtaacggttaaaccggttaaccggttaaaccgtaaacgggttaccggtaggttaccccggtaacgtacccgtaagttcccggttaacc

SEQ ID NO: 68919 - DNA, 742 bp, Homo sapiens
  misc_feature: GYAE6OF01A0QS7.51.76.G10.1.454.CMB.1.raw
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggaccagacggaacatggaagccccagcgcagcttctcttcctcctgctactctggctcccagataccactggagaagtagtgatgacgctagtctccagccacctgtctgtgtctaccgaggggaanacnccaccctctcctgcacgggccagtcagtagtgttagcgagcgtacttacgccgttggaccaggacaacgaaccgtcggaccaacggtcctacccgacggtccctaccctactataccgtaagtcggtaactcggtaacctaccgtacccgaaaccggaaccgggtaccctaccggtaataaaccgttaccctaaccccgacggtcccgttaacggggttacgtaaggggttccgggacgttagggggtttccggtacgggtacgggactacggtacgtttaccaccgtctaccacgtactcgaacgtccgacggtcctagacgtagtacgtacgtaattacgtttacgacttttaatttacgttacgtactagacgtaacggttaacttaagtaacgttaaccgtccggttaacctaccggttaaccttccggttaacgggaccggttaaccgggaaccgtaacggtacgtacggtaaggtaacccgtaaacggtaaacgttaacgggttacgtacggtagtaacccgagttacccttaaccgg

SEQ ID NO: 68920 - DNA, 624 bp, Homo sapiens
  misc_feature: GYAE6OF01EOB44.51.76.G10.1.454.CMB.1.raw
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaancgccaccctctccgtgcgacggccagtcagagtgtagcagcgattagcctgtaccngacagaacctgccaggtcctcccgagtcctcctgtactcgtgtcggtcgcacgtccaccgagggccctacgcggcctactacccgagacccgtaggttcaggttcggacgtaggtcgggtcgtgggaccgtacggtaccgttcgactcccgtacacctacgtcgacgtcaccgtccgtagacgtccgtagtaagttgttttacggactttagtttattagttacgtcgacagtacgaacgtaacacggtcgtacgttccgtagggtccgttacgggaccgtaagggaccgtaacgggtagtaacgttaacgaagtaccggtagtaccggtacgtccggtaaccctacggtattcccgttagttccgttacccg

SEQ ID NO: 68921 - DNA, 555 bp, Homo sapiens
  misc_feature: GYAE6OF01BR5LM.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacgagggggaggaactggctcagttaggacccagacggaaccatggaagccccagcgcagcttctcttcctcctgctactctggctcccagactaccgactgggagaagtagtgatgacgcagtctcagcccacctgtctgtgtctccgaggggaaangccacctctcctgcacgggccagtcagagtgttagcagcgacttagcctggtaccagcaagaaaccgtggaccaggcctcccgaggcctcctcatcctagtgagtcgtcgactccgacgaacgggccaacgtgactactcccagcctaggttcacgtcggacgtaggtggtcgtagggactgagttcactctacacatcacgtcacgctagctagtctagtaatgtttacgacttaatttactactgtacgatactaagtactaaatcgtaggtccttacgacttagttcggacgtaggggacctaggcgtaggacacgaactaacggacttcggacgctacggcctacggtac

SEQ ID NO: 68922 - DNA, 664 bp, Homo sapiens
  misc_feature: GYAE6OF01ELU86.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaagggaagcgcccaccctctcctgcgagggccagtcagtagtgttagcaggcgtacgttacgccgtaggtaccagacaacggtaaacctcggacccgaaggcctacccgaggtcctcctacacttcctagtgattcgacactaccaacgaacgggcctacgtagactacgtacccagtccgtaggttcgaggtcggcgtagggttcgggtcgtacgggacgtagtacgttcacgtcctaccacgtactacgacgacacgctacgtcagtacgttaagtaagtttacgtttagtaacgttaacttttagttacgttacgttagtaacgtcttaagttaacttaaacgttaaccgttcggtacccttacccgttacttaccggttttacgggaacccggtaacgggaacctaggtcgttaaggaacgtacgtaaccgaaaccggtacgttacggttacgcgtcgacccgtacgtaacg

SEQ ID NO: 68923 - DNA, 645 bp, Homo sapiens
  misc_feature: GYAE6OF01DNJUM.51.76.G10.1.454.CMB.1.raw
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (312)..(312): a, c, t, g, unknown or other
  misc_feature (312)..(312): n is a, c, g, or t
  modified_base (635)..(635): a, c, t, g, unknown or other
  misc_feature (635)..(635): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccctaccctgtcctgtcgtactccgaaggggaaacacgcccaccctctcctgcgacgggccagtcgagagtgtancaggcacttagccgtagacagcaacgaacngaccacggcctccgacggtcctcctagtactactaagngtacgtacgactaccgtaccgaacgaaacgggtccctaagtacgtaactaccgtaccccgagtaccggtaggttacgaggttacggcggtaggggttcggtacgttaagggactagtaaccgttcacctcactactaagccagtacacgtcgagtacgtagtacgtagtaactttacgtttactaaactttaagtttactaggtagttaacaacgttacgtaaagttacctaaacggttaccgtccgtaccctttacgtacggttacgttacgggaacgtacgtaacgtacggtataggactaagtaacgacgtagtgacgancgctacgtac

SEQ ID NO: 68924 - DNA, 754 bp, Homo sapiens
  misc_feature: GYAE6OF01CKD5T.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagcccaccctgtctgtgtctaccgaggggaancgcccacctctcctgcacgggccagtcagagttgtagctacgcgacttagcctaggtaccagcaacgaaaccgtcggaccacggacctcccgaggtcctcctctaacgttcctaagtggactcggtaccacttacccaacggaacggaccctacgtacgtactaacccttacccgaacggtaccgtaggtttaccgagggttcgggcgtaagggttcggggtacgttaggggaacgtaggtttactaccgtaccgttctaaccctactacgttaccgacggaccgtacgtccttcgacgttacgtaccgttaaggtaacgttagttttacgtagtttaacttttaacgttaccgttagtaccgttaagtaacgttaaagttaacgttaaaccgtttaaccgtaccggttacccgtttaacccggttacgttaacccgggttttacggacccgggtaaaccggggttaaccgaaccggttacgtacgggtaaacgtaaacgtaacccgtaaacgggtacgttacgggtacggtaccgtacgtaccgtacttaccgg

SEQ ID NO: 68925 - DNA, 631 bp, Homo sapiens
  misc_feature: GYAE6OF01BJWK5.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcgagggccagtcagagtgttagcagcgacttagcctggtaccagacaagaaacctggacccacggcctcccgaggccttcctcactctatgatgcatccacgaacgggccatagactactcccagccgtaggttcaggtggacgtaggttcgggtcgtgggactaggtacgttccacgtctacacctactcgacgcacgtcctgtctacgttcgtagtaagttagttttgactttaagtttacttacgttgtacgtagtacgtaagttaacttaagttaaccgttcggtacccgtttaccgttaacgttaccgttttacgggacccggtaacgggtaaccgtaacggtcgtacgggtaagtaacgtaaccgtaaaaccgtaacgttacggtacggtacgtacgacccgttaccgtaccg

SEQ ID NO: 68926 - DNA, 771 bp, Homo sapiens
  misc_feature: GYAE6OF01AYQBC.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccgagggaaancgccaccctctctgcgacgggccagtcagtgtgtagcagccacgttagccttggaccagacctaacgaaaccgtcggaccctagggacccttacccgaaggtccccttacctactaacgttctaagttgaacgttgaccacgtacccgaaacggaacggtcccaagttcgtaaactaccgtacccgtaacggaccggttaacggttacgtacgggtacgggtaccgtagggttaccggggttcgtacgggggtaacctaaggtaacggtttacccaccctttacccgtaccgtaacccgtaacgtaccgaaccggtccgtaaacggtcccgtaacgtaccgtaacggtttaccggtaagttaaagtttacggttttactaaacgttttaattttaaccgttaccttaggtaacccgtaagtaacgttaaaggtttaaactaaacgttaacgtccggttacccgtttaccgtacgttacggttaccgggaacgtacggtaaaccgtaggtccgtaaggaacgtaccgtaacggtaaacgtaccgggtggtaccgtaacgctacccgtaacgtttacg

SEQ ID NO: 68927 - DNA, 713 bp, Homo sapiens
  misc_feature: GYAE6OF01DJ23Y.51.76.G10.1.454.CMB.1.raw
  modified_base (200)..(200): a, c, t, g, unknown or other
  misc_feature (200)..(200): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagcctacccgtgtctgtgtcctaccgaggggaaanacgcccaccctctcccgtgaccgagggcctagtcaggtagtagtagcagcgacttacgcctagtaccagacaacgaaaccgtcggaccgaggcctccgacgtcctccgtacatcgtatcgagtcgacactccaagaacggcctatgactacnccgagtccgtaggttcaggttcgacgtaggttcgggtacgtaggtaacgtacggttacgttacctactacctaaccgtaaccgtagtaccgacgtaccgtaccgtccgtacgacgtaacgtttaccgtagtaaacgtttagttttacgaaacgttttaaacgttttactttacgtcgttaaccgagtaaaccgtaagttaaacttaaacggttacgttccggtaccccgtttaacgttacccgtttaccggtttaacgggaacccgggttaaagggaacctaacgggtacgtaagggaacttaaccggaaaccgtaaaacgtacggttacggtaccgagtacccgacgttaacgttaccgg

SEQ ID NO: 68928 - DNA, 653 bp, Homo sapiens
  misc_feature: GYAE6OF01B1OOK.51.76.G10.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
  modified_base (327)..(327): a, c, t, g, unknown or other
  misc_feature (327)..(327): n is a, c, g, or t
  modified_base (452)..(452): a, c, t, g, unknown or other
  misc_feature (452)..(452): n is a, c, g, or t
tcagcgatcgtatacacgaccggtgctcgatttagtcactcatacagggggaggaactgctcagttaggacccagacggaaccatggaagccccagcgcagcttctcttcctctgctactctggcctcccagtactaccacgtggagaagtagtgactgacgcagtcctccagcccaccctgtctgtgtctcgaagggaacncgcccacctctcgngcgacgggcctagacgagtcgtagtagcgtagcgacttgcctggaccagacgaacgtaaccgcggaccgacggtccctacccgaggtccctcctatacttacgtacgtacngttcacctactaccgaacgaacgggacctacgtagaaccttccacccgagtacccggtaaggttaccgagggtacgacggtacgggtgggtcgaacggatacggtagttccacgtcaccactacncgtacgcgtacgaccttaggccaggttacgagaactttggttaactacgtttaactttacgtaccgtataccgtagtacgtaagttactaacgttaagtccgttaccttaacgtacgttacggttccgacggttaagacccttagggacttaacggagtcgttaacgaaacggttacgtgggtagacctacggctcctagg

SEQ ID NO: 68929 - DNA, 743 bp, Homo sapiens
  misc_feature: GYAE6OF01EQ2E5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctcgaggggaaancgcccaccctctccgtgcgacgggccagtcgagtaggtgtacgcaggcgtacttacgccgtaggtaccgagaccgaacgaaacccgtggacccgacgggtcctacccggaggtccctccgtctacgttctacgttgatcgacctactaccgaacggacgggacccagtagactaccgtacccgacgtccgtaggttacgacggtggtacgtagggtttcggtccggttagggactacgggtacgtttaccaccgttacctacccgaccgtactacgacgtacgtacgtaccgtgtaccgtacgtacgtagtaacgtttagtttactaacgttttaatttacgtttacgttacgtacgaaccgtagttaaacgttaaacttaaccgttacggttacccggtttaccgttaacccgttacccgtttagggtttccgggaaccccgggttaggtaaacccggttaacggttacgggtacggtaaacggtacccttaaaccggaaggtttaccgtacgggtacggtacgtccgtacccgacttttaaccgg

SEQ ID NO: 68930 - DNA, 572 bp, Homo sapiens
  misc_feature: GYAE6OF01EWJPN.51.76.G10.1.454.CMB.1.raw
  modified_base (196)..(196): a, c, t, g, unknown or other
  misc_feature (196)..(196): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (426)..(426): a, c, t, g, unknown or other
  misc_feature (426)..(426): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgattagcctggtaccagcagaaacctggaccaggctcccaggcctcctacatctatgatgcatcccacgaagggccaatgaatancccanccaggtcagtggcagtgggtctgggacaggattcactctcaaccatcaagcagcctgacagtctaggaatagttttgacttaaatttatttactcggtanagactaagtaattaaacgttaaacgtggtaccctacgttaacctacgttttacgggccgtaaagggggaacccaaaggtccgttaggaacggtaaactaccgaaaaaccggtaaacgttggtacgggacttacggacctactaacg

SEQ ID NO: 68931 - DNA, 838 bp, Homo sapiens
  misc_feature: GYAE6OF01DNM15.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagactaccacgtggaagaagtagtgatgacgcacgtctaccacgcccaccctgtctgtcgtcgtaccgaaggggaaacacgcccaccctctccgtcgacgacggcctagcgagtagtagtagcgacgacgtacttacgccgtagtaccagacgaacgaaaccgtcggaccgacggcctacccgacggtcctccgtataacttctagcgtactcgactacgtaacccaaggaaccggacctagtacgaacttaccacccgaacggtaccgtaggtaccgagggtacggtacggtacggggtttcgggtaccggtaggggtaacctaaagggttacccgtttaccgtacccgttaacccttacccgaacccgtaacggttacccgaaaccgtcccggtaaccgtcccgttacgggtaccgttacggttaacgtaacggtttaaacggttaacgttttttaacgtaaacgttttaaacgttttaaccgtttaaccggttacggttaaccgtaacgttaaaccggttaaagttaaaccgttaaacggttaaccggttacccgtttacccgtttaaccgttaaccggtttaccggtttaaaccgggaccgggtaaaacccgggtaacgtaacggtaacggtacgggtaaacgtaaacgtaaaccggtaaaccgtaacggttgtaaccgacggtaccgtaccgtaacggtaacc

SEQ ID NO: 68932 - DNA, 842 bp, Homo sapiens
  misc_feature: GYAE6OF01CWHZH.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggcctcccagactaccacgtggaagaagtagtgatgacgcacgtcctccgacgcccaccctgtctgtcgtccgtaccggaaggggaaacaccgacccctaccccttccgtcctacggaccggacggggacccgtaggtccgaaggtaggttacggtacgacgacggtaccggttaacgtttacggaccggttacggtaaccacggaaccaacggaaccgtcggacccgtaaccggcccgtacccgacgtcccttacctactacttcctagtgactcgtaccaaccgtaccgaaacggaaccggtaccctaacgtaggtaacctaccgtaccccgaaggtacccggttacggttacggagggttcgggaccggtagggttcgggtacggacgggtacgtacgtacgttacccgtaccttacgaccaacctacgtaccgacggtccgtaccggtacccgtagtaccgttaacggtatttaacgggttaacgttttaacggttttacctaaagttttaacgttttaccgtttagttacgttaccgtaacgtaaatttaaggttaaccttaaacggtttaacccggtccgttaacccgtttaaccgttaaccgttacgggtttacccggaaccgggttaaccggaacgtacggtacggttaaggacttaaacgaaccggttaaacggtacgtacggtacaccggttacaaccgtcgttaaccg

SEQ ID NO: 68933 - DNA, 867 bp, Homo sapiens
  misc_feature: GYAE6OF01CX6YG.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccactggagaagtagtgatgacgcagtctccagcccacctgtctgtcgtctaccgaaggggaancgcccaccctctcctgcgacgggccagtcgagtagtgtacgcagtcgaacttcgccgtacggtaccagacaacggaaacctcggaccaacggccctacccgacggtcccttaccctactaattccgtaagtcgacgttcgacctaacctacccggaaacggaaccgggaccctagttacgaaccttaccgtaccccgaggtacccgttaggttccgaagggttcggaccgtaaggggtttcgggtaccggtagggtactacgggtttaccttacccgtaaccttccgtacccgtaaccgtaaccgttaacccgaacccgttaacgtaaccggttaacggaacccgttaccggtaacgttaaacggttttcgtttttaccggaaccgttttaaacgttttttaaccgtaaccggttttaccggtaaccgtaacgggttacccgtaaaccgggttaaaccgttaaaaccggttaccggtttaccggttacccgtttaccggtttcccggggtttaccgggggaaccggggtaaacccggttaacgggtaaacgggttacgggtaacgtaaaccggtaaaccggtaaaaccgggtttacggttacggtaccggtaccgtaccgtaacccgtaaccttacgtttaaccggttcgtttaaccccgttacccg

SEQ ID NO: 68934 - DNA, 947 bp, Homo sapiens
  misc_feature: GYAE6OF01BU7FC.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccacgtggagaagtagtgatgacgctagtcctcacgccctacctgtctgtgtctaccggaagggaancgccctacctctcctgcgagggccagtcgagtgttgtacgcagtcgtacttacgccgtacgtaccgagtaccgaaacgtaaccgtcggacccagggcccttaccccggacggtcccttaccctactaaccttacgttacgtaggtacgtccgtacccgtaaccttaacccgaaaccgggaaaccgggtccctaacgttaacggttaactaccccgtaacccggacgtacccggttaggttacggacgggttaaccggcgttaggggttacggtccggttaaggggtaccgtaagttaccggttacctacttaaccccgttacgaacccttagtaccgaaccggtacgtaccgtaccggtcggtaaccctacggtttaacgttaacgggttaaacttttcggttttaaacgtaaccttttttaaagttttaacccggttttaccgtaaacggtttaaccggtaagttaaaccgtttaaacggttttaaaaccctaaacgggtttaacccggtttacccggtttaaccccgtttaaccgggtttaaacccggttttaccccgggggtttaaacggggtaaaccccggggttaaacccgggggttaaaaaccccttacggggtaacccgggtttaaagggtaaaccccggttttaaaaacggtaaaccccggttaaaaccgggttaaacggtttccggggaaacccggtttagggaccccttaaacccccgttacgtttaaaccccggg

SEQ ID NO: 68935 - DNA, 790 bp, Homo sapiens
  misc_feature: GYAE6OF01B0E2L.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccgaaggggaangcctacctctcctgcagggccagtcagtagtgttagcgagcgtactagcctaggtaccagcaacgaaaccgtggaccaggtcctacccgaggaccctcctacagttacctagtcgacgtcggacctacgtacccgaacggaacgggccctaacgtcggtaactccgttaccccgaaggtccccgtaagggtttccgtaacgggttccgggacgtacggggtttcgggtacggtacgggaaccgtacggtacgtttccaccgttccgtacccgtaaccgtacgtccgagaccgtacgtccccgttacggaccgtaacgggtttactaggtttaaacgtttacgtttttagaacccgttttaaagtttttaaccgttacggttacgggttaacctacggttaaccgtttaagggttaaaccttaaaccgttaaccggtccggttaccccggtttaacccggttaccgttaaccgggttttaccgggacccgggtaagggtaaaccccgtagggtaccggttaggaaaccgtaccggtaaacccgtaaaacgggtaccgttgggacccgttaccgtacgtacccgttacgttaaccg

SEQ ID NO: 68936 - DNA, 725 bp, Homo sapiens
  misc_feature: GYAE6OF01BVKTP.51.76.G10.1.454.CMB.1.raw
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctcgaaggggaancgcccaccctctcctgcgaggccagtcagngtgtacgcagcgtacttagccgttggtaccagcaacgaacctggaccaggcctcccgaggtcctcctcactctatcgactcgactactaccgaacggaacggacctacgtacgtactacctacccgacgtaccgtacggttccgaggtcggacggtagggttcgggtcgtacggggaaccgtaggtacgtttaccgtacctccgtaccacctacgtaccgacgccgacgtcccgtagcctacgttaccgtaggttaatttcgttttacgaacttttaagttttacgtttaccgttacggttacctaacgttaacgtaaagtttaaacttaaacgttaacccgttaccggttacccttaacccggtttaaacctttccgggttttaccgggacccgggtaacgggtaaacccacgggttacgtaacgggtaacgtaacgtaaacccgggtaaaaccgttcggttaccgggtacgtaccggtacctaccgtaacccgttacg

SEQ ID NO: 68937 - DNA, 708 bp, Homo sapiens
  misc_feature: GYAE6OF01B0TQ6.51.76.G10.1.454.CMB.1.raw
  modified_base (196)..(196): a, c, t, g, unknown or other
  misc_feature (196)..(196): n is a, c, g, or t
  modified_base (703)..(703): a, c, t, g, unknown or other
  misc_feature (703)..(703): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctcagcccacctgtctgtgtcctcgaggggaancgcccaccctctcctgcgagggccagtcagtagtgtagcagcgacttgcctaggaccagcaacgaaccgtggacccgacggcctacccgaggtccctccgtactatccgtaagtcgtatcgacctactacccgaaggaaccggtccctaagtacgtaactacctacccggacgtacccgttaggtttaccgaggtttcgggacgtacgggtttccggggttacgtacgggggtaacctacgggttaccgtttacctaaacccggttcccgtaaccgtaacccgtaacgttaccgaaccggtaccgtaaccggtcccgtaggtaccgtacgtacgttaacggtaacgtttacgtttacgtaactttaacgtttacgttacgttacgtactacgtactaagttaactaacgttaccgtacgttaccttaccgttacgttccggtttacggaaccgtaccggtacgagtcgtaggactacgtacgtaacgtcgtagtacgacgtcgtacncgtac

SEQ ID NO: 68938 - DNA, 683 bp, Homo sapiens
  misc_feature: GYAE6OF01A6881.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagacgcccaccctctcctgcgagggccagtcagagtgttagcagcgacttacgccgtggtaccagcaagaaacctggccaggcctcccgaggcctcctcatctagtgatcgcactaccacgaacgggcccatacgtatacctcccgacgtccgtaggttcgaggtcggcgtagggttcgggtcgtaggggactaggtacgttcaccgtcctacgacctactacgaccgacacgtcccgttagacgtacggttactaacgggtaaagtttcgttttacgtaacttttaaatttttacgttacgttactaccgtaattccggtaaagttaactaaaccgttaacgttccggtaccccgttaaccgttaccgtttaccggtttaccgggaacccggtaaccggggtaaccgtaaggtccggttagggaacgtaaccaacggtaaaaccggttcggtaggttacgggaacttcccgaacgtacccgttacg

SEQ ID NO: 68939 - DNA, 851 bp, Homo sapiens
  misc_feature: GYAE6OF01A5FCN.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatgggaagccccagcgcagcttctcttcctctgctactctggctcccagataccactgggaagaagtagtgatggacgcagtctccagcccacctgtctgtgtctccgaggggaaacncgcccaccctcgtcctggacgacggggccctaagtcaaggtagttcggttacgcaggtccgtaacgtttagcccgtaggtacccaggccaaaaacggtaacccgtgggacccaacgggtcccttaccccgaggtcccttacctcgaacttactaagtcgtaacgtcggacctaacgtacccgaacggaaccgggcctacgttacggaacttacctcccgaacggtccgtaaggtttaccagggtcggccgtaagggttccgggtcgtacggggacctaaagggttactttccaaccgttaccttaccgaacctacgtaccgtaacgaccgtacgtccgttacgacgtaacggttcgtaaggttaacgttacgttttacggtaactttaaacgttttacgtttaaccggttacgtaaccgttacggtaacgttaaacggttaaacgttaaaccgtttaaccgggtttaccggttaacccgttacccgggtttaaccgtttaaccgggttttaaccgggacccgggttaaacggggtaacccgtaaacggggtaccgttaacgggtaacggtaaacggtaaaccccggttaaacggtaaaccggttacgggttaccggtaacgttacccgttaaccgtaacccggttaaccg

SEQ ID NO: 68940 - DNA, 701 bp, Homo sapiens
  misc_feature: GYAE6OF01B1PX7.51.76.G10.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (686)..(686): a, c, t, g, unknown or other
  misc_feature (686)..(686): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaacncgccaccctcncctgcagggccaggtcaggcgtgttacgcagcgacttagccgttggtaccagcaagaaacctggacccaggtcctcccgaggcctccgtcaactcttagtcggactcgacctactaccaacggaacggccctaagcgtaatactcccgaagtccgtaaggtcgaggttcggacgtaggtttcgggtacctaggggtacaagggttacgttacctaccgtttacctaccgtaacccgtacttaccgaacggtaaccgaaccgtcccgtagaccgtaggttccgtaaagtaacgggtttactttagtactttaaacgttttagttaaccttgtaaccgtagtacgttaagttaaaccttaacgttaacgttccggtacccgtttacgttaaccgttacggttttaccgggaccggttaacgggaaccgtaacgggtcgtacggtaacgtaacgtacgtaaaccgtacgtcggtcggtaanccggtacacgtaccg

SEQ ID NO: 68941 - DNA, 896 bp, Homo sapiens
  misc_feature: GYAE6OF01ELLDM.51.76.G10.1.454.CMB.1.raw
  modified_base (211)..(211): a, c, t, g, unknown or other
  misc_feature (211)..(211): n is a, c, g, or t
tcagcgatcgtatacacgaccggtgctcgatttagtcactcatacagggggaggaactgctcagttaggacccagacggaaccatggaacgccccagctcagcttctcttcctcctgctactctggctcccagactccacggagtaaattgtgttgacacgagtcctccgaggcctacccgttgttctttcgcctaccggaaggggaaacncgcccaccctccgtctgccgagggcccagtacgagtagtgttacgtctactttcgtacgtcctacggtaacccaacaaccgtaaccgtcggacccacggcctacccgagtcccttccgtacttattttacgtgacgtcggactaacgtacccgtaaagggacccgggcctaacggtccggtacccgtaccccgaagtcccggtaagttcggacggtacgggacgtaggggttaccggggtacggtaccgggactaaccggttaccttacccgaaccctttccgtaaccgtaaccgtaccgtagaaccggtacctaacgggtacccgttaacgggtacccgtaccggtttaaacggttaaaccgggtttagtttttaacccggttaaacttttaaagttttaaaccgtttaccgtttaccgggtaaccgtaaccgtaaccggttaaccgggtaaaccggttaaccgttaaccgttacggtttaccccgttccccggttaacccgtttaccggaacccgtttacccggtaccccgtttaacccggggaacccgtaacggggtacccgaaccgggttaaaccgttgggtaaaaccgaaaccgttaaccgggacgttacgggtactaccgggtacgtaccccgtaacgttccgttacccgttactttccctaccgttcccttaccccgg

SEQ ID NO: 68942 - DNA, 792 bp, Homo sapiens
  misc_feature: GYAE6OF01C1HV7.51.76.G10.1.454.CMB.1.raw
  modified_base (170)..(170): a, c, t, g, unknown or other
  misc_feature (170)..(170): n is a, c, g, or t
  modified_base (207)..(207): a, c, t, g, unknown or other
  misc_feature (207)..(207): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggcctcccagtactaccacgtggagtaagtagtgatgacgcagtcnccagccaccctgtctgtacgtctccgaaggggaaacncgccctaccctcgtcctagcgacgggcctaaggtcaaggagttggtacgcgagtcgtactttaggccgttaggtaaccagacgaacgaacctcggaccacggtcctacccgaggtccttacccctagtacgttcgtaagtcggtatccggacctacgtacccgaacggtaacggtcccctaagtacggttactaaccggtacccccgaaggtaccccgttaaagggtttcctaagggccgggtacgtaacggggtttcgggttacgaacgggggtactaaacgggttccgtttaccacctttcccggaacgtaacccacgttacggaacggaccctagacccgttacggtacgtaaggtttacccaagggttaacctttagtttacgaacctttaaacgtttattaccgtgtacctaagtaccgtaaagttactaaacgttaccgtacgggttaccccttaaccgttaacgttccggtttaaccggacccgggaaacggggtaccctaagggtccgtaagggacgttaaccgttaaccgaaaccgttacgtcggacggtacccttcgaacccggttacttaccgg

SEQ ID NO: 68943 - DNA, 810 bp, Homo sapiens
  misc_feature: GYAE6OF01DS8ZM.51.76.G10.1.454.CMB.1.raw
  modified_base (207)..(207): a, c, t, g, unknown or other
  misc_feature (207)..(207): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggcctcccagactaccacgtggagaagtagtgatgacgcacgtcctccacgcccaccctgtctgtcgtcgtaccgagggaacncgccctacctcctctggcgacggccagtcgagtagttgtacgcgagcgtacgttcgccgtacggtacacgtaccgaacgtaaccgtcggaccgacggccgtacccgacggtcctccgtactactctagtcgtacgtcgacaccgtacccggaacggaaccggtaccacgtacgtaactaccgtacccgacgtaccgtacggttacgtacggtcggcggtaggggtacggtacggtacggaacgtagtaccgtcctacctccgtaaccacctagaccgacgccgacgtccgtacgtacgtacgtacgttaagttagtttacgtttaacgtacgtttaatttaccgtttacgtacgttacgaacgtttaacgttaacgttaacgttaaaccgtttacccgttaccgggtttaacccgtttaaccggtttaaccccggtttacggttaacccggggtaaccccggggttaaaccgggtaacgttaaaacccggggtcggtaaaccgggttaaccggtaaacccggttaaacccgggttaaaaccggttccgggtttacgggtaccccggtaatttaccccggggtaaaccttcccggtttaacccg

SEQ ID NO: 68944 - DNA, 778 bp, Homo sapiens
  misc_feature: GYAE6OF01AVT50.51.76.G10.1.454.CMB.1.raw
  modified_base (154)..(154): a, c, t, g, unknown or other
  misc_feature (154)..(154): n is a, c, g, or t
  modified_base (461)..(461): a, c, t, g, unknown or other
  misc_feature (461)..(461): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactgggagaagtagtnatgacgcagtcctccagcctaccctgtctgtcgtctaccggaaggggaacacgcccaccctctccgtgcgacggggacctaggtacaggtacgttagtacgcgtacggccgttacgttacggcccgttacggtaaccagaccgtaaacggtaacccgtcgggacccgaaccggtccctccccggaaggtcccttaccgtactacgttaacctagtacgtacgtccggacctaccgtaacccgaacggtaacccggtacccgacgttacgaaccttaccggacccgtaaccggtccgttaacgggttntaaccggggtcgggtaccggtacggggtttcgggtcggttaaccggggaacttacggggttacttaccgtacctacccgttaaccaaccgtacgttaccgacgtaccgtacgtcgtaccgtaacgtccttacggttacgtaagtttacgtttacgttaactttagtttaacgtacgttacgtacgttataacgtaacgttaactacgttacgtaccgtacgttaccgttacgttacggtaccgtaacggtacggtaccgtacggtcgtaggaatacgaaccgtaaagtccgtacgacgtacgacctcgtaacgtccg

SEQ ID NO: 68945 - DNA, 693 bp, Homo sapiens
  misc_feature: GYAE6OF01CPBS4.51.76.G10.1.454.CMB.1.raw
  modified_base (147)..(147): a, c, t, g, unknown or other
  misc_feature (147)..(147): n is a, c, g, or t
  modified_base (209)..(209): a, c, t, g, unknown or other
  misc_feature (209)..(209): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggctcccagactaccactggaanaagttagtgatgacgcagtcctccagcccacccttgtctgtgtcctaccggaaggggaaacncgacctacccgtctccgtgacgacgggccagtcgagtagtgttagacacggtccgtaacttcgccgttaggacccagtacaaacgtaaccgtggaccgacggcctacccgaggtcctacctctacttccgtaatcgaattccgactaccgtaccgaaggtacggcctaacgtagactaccgaccacggtaccgtaggtacgaggtcggcgtagggttcgggtacgagggtaacgtaggtacgttacctacctcgtaacctaccactaccgtacgaccgtacgtctacgactagttcgtaagttagttatttaacgatttaacgtttcttacgtagtactacgtaactagttaactaaacgttcgtaccggtactttaacgtactttaaccggtcgggacccaacgggttacgacggtaacggttacggaaacgttcgaaaccgtaaggttcgtagggttaccgagtacctaacccggtctaacg

SEQ ID NO: 68946 - DNA, 840 bp, Homo sapiens
  misc_feature: GYAE6OF01AWRWM.51.76.G10.1.454.CMB.1.raw
  modified_base (249)..(249): a, c, t, g, unknown or other
  misc_feature (249)..(249): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagactaccactggagaagtagtgagtgacgcagtctccagcccaccctgtctgtcgtctaccgaaggggaacacgcccaccctctccgtagccgacgggccacgtcgaggtagtcggtanccgagtcgtacttacgccgtacggaccagtcgaacgtaaccggtcggacccgaacggtcccgtacccgaggtccccttacccgtactaacgttacctacgtggtaactcccgtacaaccgtacccgaaaccggtaaccgggtcctaaccgttacgtaactacccgtacccgaacggtcctaaaggtccgaggtacgcggtacggtcgggtagacggactaggtacgttaccgtactcgtaccccgaacctacgtacgtaccgaccgtaccgtaccgtacggacgtaccgtacgttaacggttaacgttaccgttttaacgttaaacgttttacgttttaacgttaaccgttacgttaacgttaaccgtaacgtttaaacgttaaaccgtttaacgttaaccgttacccggttaacccgtttaacccggtttaacttaacccggggttttcccggaaaccgggttacccgggtaaacggttaaccggacgggttaaccgggtaaacgtaaccggttaaacccggttaaaacggttacccggttaacggttaacgggttaaccctcggtttaaaacccgtccgtttaaaccgg

SEQ ID NO: 68947 - DNA, 641 bp, Homo sapiens
  misc_feature: GYAE6OF01A729J.51.76.G10.1.454.CMB.1.raw
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtcncgagggaancgccacctctccngcgagggccagtcagngtgtagcagcgtattagctgtaccagcagaacctggccaggcctccgagcctacncatctatagactcgacactaccgaagaacggtccagttagaactacgtcccgacgtccgttaggtccgaggttcggacgtagggtcgggttgtacgggacagtacgtttcaccttcgtaccactcgacgtacgctacgcgtacgacgtaggtactaaggtattacgtttagtaactttaacgttttacgttacgtagttacgaagttactaacgttaataaacgttacggtccgttacccgttaacgttaccggttaacgtttccggaaccggttacgggaaccgtaacggtcggttaacggaacgttaaccgtaacgtaaacggttacgtacggtaggtacctacgtaacccgtgttaacccg

SEQ ID NO: 68948 - DNA, 756 bp, Homo sapiens
  misc_feature: GYAE6OF01DOYZK.51.76.G10.1.454.CMB.1.raw
  modified_base (313)..(313): a, c, t, g, unknown or other
  misc_feature (313)..(313): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaacacgcccaccctctcctgccgacgggccagtcaagagttgttagcagcgtacttacgccgtaggtaaccagaccaaggaaaccgtcggaccaacggcctacccgaggtccttcccnctactctaatgtactcgactactaccgaacgtaacgggaccctaacgtaggtaactaccgacccgtaaggaccccgttagggtttacgaaggttcgggaccgttaaggggttcggggttaccgtaggggaactagggtacttaccaccgttcctaaccgactacgtaccgacggtaccgaacgtccgttacggacttaaccggttctaaggttaaacgtttacgttttaacgtaactttaaactttttaagttaacctttcggttaacacgttaaccgtaagtttaaacgtttaaacgtaccgttaccggttaccctttaaccggttacctttaaccggttttaccggggacccggtaaaggggtaccctaaggtcggtaaggtactaaaccggtacgaaacccggtaagttcggaacgtccttaacggcccttacgttaacg

SEQ ID NO: 68949 - DNA, 892 bp, Homo sapiens
  misc_feature: GYAE6OF01BC1YU.51.76.G10.1.454.CMB.1.raw
  modified_base (721)..(721): a, c, t, g, unknown or other
  misc_feature (721)..(721): n is a, c, g, or t
tcagcgatcgtatacacgaccggtgctcgatttagtcactcatacagggggaggaactgctcagttaggacccagaaccggaaccatggaacgccccagcgcagcttcctcgttcctcctgcctactccgtcggctccccagtactaccactggagaaggtagtggatggacgtcagtcctccacgcctaccctggtcctgtcgtcctacccgaagggggtaaacacgtcccctaacccttccgtaccccttaggtaccgtaacgggggtcccctaacggttaccgtaagggttacggttacggtttaaccgaccgaacggtccggttaaccgttacggtaccccggttacgggtaaacccaacggacgtaaacggtaaaacccgtcgggaacccgtaacgggtccctaccccggaggtcccttacccctactaacttccttaagtcgtaacgttccgacctaccggtaccccaacgggaacgggtccctaattaccggaacttaccgtaccccgaacggtccccgtaaagggttccgacggggtacgggtaaccggtgggtttaccgggtagtacgggtaacaggtacgtttaccacccgttctacccgaactacgtccaacgtccgtaccgtccgtacggttaccagttacgtaacggttaacgtttacgtttacgtaacctttaaaaggttttccttacgttaaccgttagaaccgtntttaaacgttaactaaacggttacccgtcgttaaccccgtttacgttacgttaccgggtttaccgggaacccggtacgggtaaacccttaggtacccgttaaggaccgttaacgtaaacccgtaaagtacccggttcggtaccggaccttaccggtaaccctcgttaccgg

SEQ ID NO: 68950 - DNA, 626 bp, Homo sapiens
  misc_feature: GYAE6OF01DK0TA.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccacgtggagaagtagtgatgacgcagtctccagcccaccctgtctgtgtctcgaggggaaanacgccaccctctcctgcgagggccagtcagagtgtagcagcgacttagccgtggtacccagaccaaggaaacctggaccaggcctccgaggcctcctcattctatgatgaccactccaagaacgggcctaactgtaactaccgtcccaagcctaaggttcaggttcggcgtagggttcgggtcgtggggaactggtacgttcaccttcctacgtaacatacgacgcacgacctgaccgtagtacgtagtaagtttacgtttagtaccgttaatttttacttacttacgtctaaggtctaagttaagttaacgtaacgtcggtaccttaccgttacgttacgtttaccgggaccgtacgggaaccgtaggtacgtaaggtagtaacacgaaacgtacggtacgttacggactacggaccctacgtaccg

SEQ ID NO: 68951 - DNA, 635 bp, Homo sapiens
  misc_feature: GYAE6OF01EZ73B.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcgagggccagtcagagtgtagcagcgacttagcctggtaccagcaagaacctggccaggcctccaggcctcctcatctatgatcgacactaccaacggaacgggccacgtagactacctcccgaagtccgtaggttccaggtcggacgtagggttcgggtacgtagggactaggtagttaccactccgtacgacctatccgagcgtcgtccctaggacctaaggttctaacggtaagttacgttttacgaccttttaaagttttacttacggttacgtctaacgtacgttaagtaattaaacgttaccggttcggtacccttaccggttacgttccgtttagggacccgtaaggggaccctaaggtccgtaaggtactaacgtaacgaaacggttacgtggtacgaccttagcccacgttcg

SEQ ID NO: 68952 - DNA, 743 bp, Homo sapiens
  misc_feature: GYAE6OF01B8TU9.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcacgggccagtcagtagtgttagcagcgtacttagcctggtaccagcaagaaacctggccaggcctcccgaggtccctcctacgacttacctattcggattcggacctaacgtaccccgaacggtaaacggggcccctaacgttacggaaacttaccctaccccgaaggtcccgtaagggtttccaagggttcggaccgtagggtttcggggtacgtagggggaactaacgggtacgtttaccaccttccgtacctaactacgtaccgacggccaacgtcccgttacgaccgtaacgttccgttaaggtaagtttaacgtttttaggaacctttaagttttaactttaacgttacgttacgtaacgtacgttaacgttaaacttaacgttaaccggttaccggtacccgtttaccgttacctttacggtttaccggacccggtaacgggtacccgaaggtaccgtagggaacgtaacgtaaccgtaaaaccgtacggttacggtacggtactaccggcctaaccgttaccg

SEQ ID NO: 68953 - DNA, 648 bp, Homo sapiens
  misc_feature: GYAE6OF01A7P6H.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctccctgcagggccagtcagagtgttagcagcgtacttagccttggtaccagcaagaacctggccaggcctcccaggcctccctacatctatgactcgcactccgaacgaacgggccccagtgaactaccgtacccgaagtcccgtaggtttccagggttcgggaccgtagggttcggggtacgtagggggaacctagggtacgtttaccacgttccgtaccaacccagtccgaggccacgccctcggctagtctaggtacgttagttttcgactttaatttacttacgttgtacgtaggtactaagttaacgttaataaccgttcggtcccttacggttacttacggtttaccggaccgtaacgggaacccgtagtccggtagggataaccgttaaccggtaaacgtacgttacgggtacggtacctacgtccgtaccctacg

SEQ ID NO: 68954 - DNA, 791 bp, Homo sapiens
  misc_feature: GYAE6OF01EQTJU.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaancgcccaccctctcctgcgacgggccagtcagtagtgttagcagcgtacttacgccgtggtaccagcaagaacctggccagctcccgaggcctcctcatctagtgatcgctactacccgaacgaacgggaccctacgtaggtaacttaccgtaccccgacgcccgtaaggtttaccgaggtcgggaccgtagggttcgggtacgtacggggacgtaacgggtacgtttccaccgttacctacccaacctacgtaccgtaacggccgacggtcccgtacggaccgtaacggttccgttaaaggttaacgtttacgtttttacggtaaaccttttaaacgtttttaaccgtttaaccgtttacgggtacctaacggttaacgttaaacggtttaaacgttaaaccgttaaaccggtttccggttaccccgtttaacccggtttaacccgttttaacccggttttaccggggaacccggttaaaccggggggtaaaccctaacgggtaccggttaagggggtaacttaaacggttaaccgaaaacggtttaaccgttacgggtaccggtaccgtaccgtaacccgtacccgttaaccg

SEQ ID NO: 68955 - DNA, 635 bp, Homo sapiens
  misc_feature: GYAE6OF01CM9IE.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgtactgccgtaggtaccagcaacggaacctcggaccgaggtcctcccgaggcctcctccatctatgatcgacactcccaacgaacggccaacgttgaactacctcccgagtcccgtaggttcgaggtggacgaggtcgggtctagggactaggtacgttcaccgttctacacgtactacgacgcgaacgtccgtcgcgtacgtctacggtaagttagttttcgtaacttaatttacgtttacgtcgtacgacgtacgtaagttaacgtaaacgttaccgttccgttacccttaccgttacttaaccggttttcggaccggtaaccgggtaacgtaacggtcgtaggacggtaacgtaccgaacggttacgtacggttacgtcgtacgcctacgtaccg

SEQ ID NO: 68956 - DNA, 651 bp, Homo sapiens
  misc_feature: GYAE6OF01A1XNJ.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccaccctctcctgcgagggccagtcagagtgttagcagcgtacttagcctggtaccagcagaacctggccacggcctccgaggcctcctcactctatgatgacactccgaacgaacgggcccacgtgtaactactccccagccctagggtttaccaggtcggacgtagggttccgggtcgtggggaccgtagtaccggttaccaccttccaccaacctacgtaccgacggacctacggtccgtacgacgtacggttaccgtagtaacggttagtttttacgtaacgtttaattttattaccgttacgtactagtacgtaagttattaaacgtaaccggttcgttacccgtaccgttacgtacgttttcgggaccggtaacgggtaccgacggtcgtagggaacgtacctaaccgaaaccgtcgtacggtacggactcgtaccgccgtaac

SEQ ID NO: 68957 - DNA, 766 bp, Homo sapiens
  misc_feature: GYAE6OF01D0AMG.51.76.G10.1.454.CMB.1.raw
  modified_base (205)..(205): a, c, t, g, unknown or other
  misc_feature (205)..(205): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtcctccacgccctaccctgtctgtcgtcctacgaaggggaaanacgccctaccctcctcctggcgagggccagtacgagtagttgtagcagtacgacttgccgtggtaccagctaacgaaaccgtcggaccgacggacctaccgacggtccttccctacgtacttaccgttaagtgtaactcgtactaaccctaccgaaacggaacggggtaccctagttacgaacttaccaccccgtaggtacccgtaggttaccggaggtcgggtacggtagggttcggggttcggtacgggtacgtaggtaccgttacctacgtccctaccgtacctaacgttccgaaccggtaccgtcccgtaccgtaaccgggtacgttaacggtacggtttaagtaaacgtttttacgttttactaaacgtttttaactttttacgtttaaacctcggttaaccgaagttacgttaaattacgttaaaccttacgttcccggtacctttaacgtaccgtttacggttccgaacgggtaaccggtacaaccgggtgaagggaccttaaacgtaaccgtaacgtaacggtgttaccggtactaacgcccttaacgttccg

SEQ ID NO: 68958 - DNA, 858 bp, Homo sapiens
  misc_feature: GYAE6OF01CMKUT.51.76.G10.1.454.CMB.1.raw
tcagcgatcgtatacacgaccggtgctcgatttagtcactcatacgagggggaggaactgctcagttaggacccagacggaaccagtggaacgccccagcgcagcttctccttcctcctgctactctggcctcccagactaccacgtggagaagtagtgagtcgacgctagtcctaccacgccctacccgtgtctgtcgtccgtaccggaaggggaaacgaccgccctaccctccgtcctcggcgacgggacctaggtacgagtaggttcgttacgccgagtacgtacgttaggtcccgtaggtaccgacgtaacgaaccggaaccgtcgggaccgacggtcccacccggtagtcccttccgtataccttcggtaactgtaccgtacgtaacctaccgtacccggaaccggaaccgggtaccctaacggttaacgtaaccgttaaccccgtacccccggtaaggtaccccggttaacggttaccgggtaagggtccggggtaacgttcggggttacgggtaccgggtaagggtaacgtacggttacgttaccgtaacccgtaccttaccgactacgacggtaccgtccggtaacgtcccgttaacggtaccgtaacgttaacggttagttaacggttttaacgtttaaccgttaattttaacgttttaccgttaacgtcggttaacgtaacgttaaccgttaaagttacttaaaccgttcccggtaccgtttacccgtttaaccgtacgtttacgggtccggaaaccggggaccggtaaccgtaggtaaccggtaggtaaccgtaaactaacgggtaaaccggtcggtacgggttaccgagtaccaccgtacgttccg

SEQ ID NO: 68959 - DNA, 658 bp, Homo sapiens
  misc_feature: GYAE6OF01CLY6F.51.76.G10.1.454.CMB.1.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtcgtctccgaagggggaaancgcccaccctctccctggccgaggggccagtcgagtagttgttagcagcgtacgttgccgtggtaccagacaagaaccgtggaccaggcctcccgaggcctcctnactctangatgcactccgaacgaacgggcctatgactactcccagcctaggttcaggtcggacgtagggtcgggtacgtcggggaactaggttacgttcaccgttacctaccgaacctacgtaccgacgtccgaacgtccctaggacgttaacgtacgttaggtaacgtttatttttacggaacttttaaagttttcttaacgttcggttaccaggttaccttaagttaactttaacgtaccgttaccggtcccgttacccgttacttacgggtttaccggaccggtaacgggtacctaacggtcgtaggactaacgtacgaaacgtacgtggtacgacgtacgctaacgtcg

SEQ ID NO: 68960 - DNA, 872 bp, Homo sapiens
  misc_feature: GYAE6OF01C5USV.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggcctcccagataccacgtggagaagtagtgatgacgcagtcctccagcccaccctgtctgtcgtcctaccggaaggggaaacgacggccccaccccgttcctcccgtacggacgacggggcccaagtccgaaggtaggttggttaacggcgacgggtaccgtaacgtttacggccccgttacgggtaacccacggaaccgtaaaccgtaaaaccccggtcgggacccgaccgggtaccctaccccggaacggcctccctactacttcgtaacgtgtacgtacgtacgaacctaccgaaccgggaacgaccaacgtactacttaccgacccgtacgtaccgtaggtttaccgagggtacgcggtacgggtttcgggtacggtgggaacgtaccggttagttaccctacccggttaacctacctaacccgtacgttaccgaaccgtacgtacccggtacccgtacggtaccgttaggtaaccgtttagtaacgttttagtttacggttaaacctttagttttaaccctttacgtcggttaaaccaggttaaactaacgttttaaacgtaaacgttcggttaccgtaccccgtttaaccggttacgtttaccgggttaaccccggggaacccggtaacgggtaacccgggttaggtaccggtaaaggggttaacccgtaaactaaaccgggttaaacccggacttttacgggacgggttaccctaaacgggtccctaacccggtttaaccg

SEQ ID NO: 68961 - DNA, 678 bp, Homo sapiens
  misc_feature: GYAE6OF01CYACQ.51.76.G10.1.454.CMB.1.raw
  modified_base (203)..(203): a, c, t, g, unknown or other
  misc_feature (203)..(203): n is a, c, g, or t
  modified_base (260)..(260): a, c, t, g, unknown or other
  misc_feature (260)..(260): n is a, c, g, or t
  modified_base (663)..(663): a, c, t, g, unknown or other
  misc_feature (663)..(663): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggcctcccagactaccacgtggagaagtagtgatgacgcagtctccagcccaccctgtctgtgtctccgaaggggaaancgcccacctctcctgcacgggccagtccagtgtgttagcagcgattagcctgtaccngacacgaacctggaccaggcctacccgagtcctcctcatctatgatgaccacgtaccaacgtaacgggacctaacgttacgaactaccgtccccgtaaggtcccgtaggttaccgtacgggtacggacgtaggggtcggtacgtaggggaacttagggtacttaccgtacctcctacgtacctaacgtccgacggacctacgacccgttgaccttaaggtcgtaagtacgtttatttacgtaacttattttagttactacgtatagtactaagttaactaagttacgacgttaccttaccgttacttaccggtttacggacccggtaacgggacctaaacggtcggttaagggaacgtaaccgtaaaccgtaaaaccggtacgttacgggtacgtcgttaacnccggttaacttaacg

SEQ ID NO: 68962 - DNA, 871 bp, Homo sapiens
  misc_feature: GYAE6OF01BJ3Q9.51.76.G10.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (292)..(292): a, c, t, g, unknown or other
  misc_feature (292)..(292): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaangccacctctccngcagggccagtcagagtgtagcagcacttagcctggtaccagcaagaaccgtggaccaggcctcccgaggcctcctcatcctangtactcgactatccgacgaacggggcccaacgtggaacttaccgtcccaaggtccccgtaagggttctaacgggttcgggacctaggggttacggggttcctaggggggaaccctaagggtacgtttaccgtaaccttccgttaacccgaaccctaacgttaccgaaacgggcccttaacgggtcccccgttggacccgtaacgggtttaccgttaacggtaaacggtttacgttttttacgggtaccctttaaaattttttaccggtttaaaccgtttcggttaacccgttaagtaaccggttaaacgttaaacgtttaaaccgtttaaaccgggttccgggttaccccttttaacccccgggttacgtttaaccccgggttttttaacgggggaacccccgggttaaaccgggggggtaaacccctaaacggggtttacccggtttaaccgggggtaacggttaaacccgtttaaaacccgggttaaaaaccccggggttaaaccgttttaaaccgggggttcccggggttaaaccctttacccgggtaacccggttaaaccccctttaaaccgggg

SEQ ID NO: 68963 - DNA, 599 bp, Homo sapiens
  misc_feature: GYAE6OF01D7PKG.51.76.G10.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (288)..(288): a, c, t, g, unknown or other
  misc_feature (288)..(288): n is a, c, g, or t
  modified_base (594)..(594): a, c, t, g, unknown or other
  misc_feature (594)..(594): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagataccactggagtaagtagtgatgacgcagtctccagcccaccctgtctgtgtctccaggggaaanagccaccctctccngcagggccagtcagagtgttacgcagcgacttacgctaggaccagcacgaacctggccaggcctccgagcctccnctatctatgatgacacgtaccgacgaacggccagtgaactacacccagaccctaagttcgagtaggacctaggttcgggtactggggactaaggtacgttacaccgttcctaccaacctataccacgactacggcccttagacgtaacgttcgtaagtaacggttattttacggaactttaatttaacttcgtagtacaggtaactaaggttaattaaagtacgttacgtcccttacgtaccgttacgtttcggacgtacgggaaccaggtccgtaggatactaacaaacggtactggagcacgcnctacg

SEQ ID NO: 68964 - DNA, 554 bp, Homo sapiens
  misc_feature: GYAE6OF01BAIZF.51.76.G10.1.454.CMB.1.raw
  modified_base (199)..(199): a, c, t, g, unknown or other
  misc_feature (199)..(199): n is a, c, g, or t
  modified_base (288)..(288): a, c, t, g, unknown or other
  misc_feature (288)..(288): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgagggggaaanacgcccaccctctcctgcagggccagtcagagtgtagcagcgacttagcctggtaccagcagaacctggccaggctcccaggcctcctnatctatgatcgcatccaacgagggccatgactacgccagcctaggttcaggtggccgtaggtcgggtcgtggactaggattcacgtccacacntcgagcacgctgctagtcgtagtatagtttcgacttatttatactcgtctagctaagtactaactacgtcgtaccttaccgtacttacgtttcgggaccgtacggggacctaacggtcgtaggacgtaacgtaacgaaacggtacgtcggtacggtcgtacgcctaacgtacg

SEQ ID NO: 68965 - DNA, 840 bp, Homo sapiens
  misc_feature: GYAE6OF01BTJ8I.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccctaccctctcctgcagggccagtcagagtgtagcagcgacttgcctgtaccagcaagaaacctcggaccaggcctcccgacggtcctcctacatcctagtgagtcgctactcccagaacgggccctagtagtactacctacccgacggtaccgtaggtttaccgacggttcgggtaaccgtcggggttcggggttacgtcgggggtaaccctaggggtaacccgtttaccgaaccgtttaccctaaccgtaacccgtaacgttcccgaaacggtcccggaaccgtcccggttaacgtaccgttaacgggttaccgtttaacgggttaaagttttaccgttttttaacggaaacctttttaaaacgttttttaccgttttacgtttaacgggttaacccgtaggtaacccctttaaaagggttaaaccgtttaaaactttaacccgggtttacccgggttaccccgtttaacccgggttaaccgttttaaccggtttttacccgggggaacccggttaaaccgggggtaaacccgtaaacggttaccgggttaacgggtaacgtttaaacccgaaaccgggttaaaaacccgttacggttacggtacgggtacccttaccgaacccggtaccctttaccgg

SEQ ID NO: 68966 - DNA, 658 bp, Homo sapiens
  misc_feature: GYAE6OF01BGMCJ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctcgaggggaanacgcccaccctctcctgcgagggccagtcagagtgtagcagcgtacttagcctggtaccagcaacgaaccgtggccagacctccgagtcctcctcattcctatcgatcgactactaccaacgacgggccctaacgtcgtacttaccgtacccgacgtacccgttaggttcgtacggtacggtccgtagggttcggggtacgtaggggaacctaggtacgttcctaccgttccgtacctaaccactcgaacgctacgtacctgccgtagtacgttagtagttactttagtactttaagtttattacgttagtactacgtacgtaagttaactaacgttacgttaccggtaccttaccggttacttacggttccgggaccgaacggggtaaccgtaggtaccgtagggaaccgttaacgaacccgtaaagtacggttacggcggtacgtaccaccgtcctacgg

SEQ ID NO: 68967 - DNA, 777 bp, Homo sapiens
  misc_feature: GYAE6OF01EYM6S.51.76.G10.1.454.CMB.1.raw
tcagcgatcgtatacacgaccggtgctcgattttagtcactcatacaggggggaggaactgctcagttaggacccagacggaaccatggaagccccagcgcagcttctcttcctcctgctactctggctcccagataccacgtggagaagtagtgatgacgcagtctccagccaccctgtctgtgtctcgaggggaagcgcccaccctctcctgcgacgggccagtcgagtagttgttacgcagcgtacgttacgccgttacggtaaccaggtaccaacggaaacccgtgggacccgacgggccttaccccggaggtccctcccttactattacctataggtactcggactaacctacccgaacggaaacgggtcccaacgttacgaacttacctcccgaacgtcccgttaaggttccgaagggttcggtaccggtagggttcggggttacggtacggggaacctacgtacccgtttccggaccttcccgtaacccgaacccgttacgtacccgtaacgccggtaaccggtacccgtaaggtaccgtaccgttaaggtaaacgtttacgtttttacgtaacttttaaggttttaactttagttcggtacctaggaccgtaacggaaccgtaaaccgtacgttaccggttcccttaccgggttacgggtacccggttacggaaccggaacggggttaaaccgaagggttaacggaaactaaccggtaaacgacggttcggaacggtcttacggacctaccttacttcgttcgttaccc

SEQ ID NO: 68968 - DNA, 812 bp, Homo sapiens
  misc_feature: GYAE6OF01DDVYW.51.76.G10.1.454.CMB.1.raw
  modified_base (202)..(202): a, c, t, g, unknown or other
  misc_feature (202)..(202): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtcgtctaccgaaggggaaacncgccctaccctctccgtgccgaacggggccaaggtcaaggtagttgttagcacggtccgtaacgtttcgcccgttaggtaacccaagaccgtaaacggaaaacccgttcgggacccgaacggggtccccttacccgacggtcccttcccctacgtaacttccgtaagtcgtaacgttcgaccctaacgttacccgaaacgaaccgggtccctaacgtcgtaaaccttaccgaccccgtaacggtaccgttaacgggtttaccgacgggttacgggtaccggtaggggttcgggtaccgtaaggggtaactacggttacgttaccacccgttcacctaacgtactacgaacgccgtagtccccgtagtacgtaacggttgtaaccggttaaagttcgtttttaacggaaccttttaaagtttttaaccgtcgttaacggttctaaacggttacgtaaacgttaactttaaacgtaaccgtttccggtaaccctttaccgttaacgttaccggtttaaccgggaccggtaacgggaacctaggtaccgtaagggaactacgtaaacggtaaaccgtacggttcggtacgtcgtacgtacccgtaagttaccg

SEQ ID NO: 68969 - DNA, 711 bp, Homo sapiens
  misc_feature: GYAE6OF01C1AVU.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtcctccgaggggaaacncgccaccctctcctgcgagggccagtcagagtcgtagcagcgacttacgcctggtaccagaccaagaaaccgtcggaccaggtcctacccgaggcctccctcattcctatgatgaccactacccgaacggtaaccggccctaacgtcgaactaccgtccccgaaggtcccgtacggttacgtacgggtcggtacgtacgggtacgggttcgtacggggaactacgtacgttcctaaccgttcctaccgtaccgacgtccgaacgtccgacgtccgtacgcgtaagttaccgtaaggttaacgttaagttttccgtaactttaaacttttaactttacgtacttacgtaacgtacgttaagttaaacttaaacgttaccgttccgttaccccttaaccgtttaccgttacggtttaccgggacccgggtaaacgggtaccaacgggttacgacggtaaacgtacgtaaacccgtaaaggtaccgtacggtacgtactacgacgtacgttaccg

SEQ ID NO: 68970 - DNA, 781 bp, Homo sapiens
  misc_feature: GYAE6OF01CS24H.51.76.G10.1.454.CMB.1.raw
  modified_base (203)..(203): a, c, t, g, unknown or other
  misc_feature (203)..(203): n is a, c, g, or t
  modified_base (737)..(737): a, c, t, g, unknown or other
  misc_feature (737)..(737): n is a, c, g, or t
tcagcgatcgtatacacgaccggtgctcgatttagtcactcatacgaggggggaggaactgctcagttaggacccagacggaaccatggaagcccagcgcagcttctcttcctcctgcttactctggcctcccagactaccactggagaagtagtgatgacgcacgtctccagccacctgtctgtcgtactaccgaggggaanacgtcccacctctcctgaccaggggcctagtcgagtagttgtagctagtacgtacgttacgtcccgtaggtaacccagccgtaacggaaccgtcgggccgaaccggtcctaccgacggtccttcctactacttaccgtagtcgactaccgtctaaccgtacccgaacggtaaccgggacctaacgttacgaaccgtaccgacccgagtacccggttagttcggaggtcgtacggttacggggtacggtcggtaaggggtaacccttagggtaccttttaccgaacgttaccttccgaaccctaagttccggaccgtaaccgttccggtctaacgcggttaactaaccggtagtttacgtaccgttttagtaccttaattttacggtacgtacgtacgtaacgtacttaacggtacgttaaacgtcgttaccggtcccttttaaccgaggttaccccggtttagaaccccggggaccggttaaacgacggttaaccgggttagggtaaaaccgtccggtaaaacgttaacccggnggtttacgaaccgggttacctacgggaacccttaggtttacccg

SEQ ID NO: 68971 - DNA, 732 bp, Homo sapiens
  misc_feature: GYAE6OF01CQMKO.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctctgctactctggcctcccagactaccacgtggagaagtagtgatgacgcacgtcctccagcccaccgtgtctgtcgtccgtacggaaggggaaacacgccctaccctcgtcctgcgacggccagtacgagtagtgtagctagtccgacgttagccgtaggtaccagacgaacgaacgtcggccgacggcctcccgacggtcctccgatactacgtagttcgatcgctacaccgaacggtacgacctagtacgtactaccgcccgagacccgttaggtacgaggtcggacggttacgggtcgggtacggtacgggtaagtacgttcgttaacctaccttacgacccgtacgtagtaccacgtaccgaccgtcgtcgacgttaaggtaccgtggttaaacggttacttttaaccggttaatttaacgttttcgttaacgtacggtaattaacgtacgttaaacgttaaacgtaaacgttacccgttacggtaaccccgtttaacgttacgttacccgggttacggttacccgggaaaccggtaccgtaacggttcggtaacgtaaacggacgtaaaccgtaaaggttcggtacggtcggtacctagtacccgtaccttacgg

SEQ ID NO: 68972 - DNA, 629 bp, Homo sapiens
  misc_feature: GYAE6OF01BOISA.51.76.G10.1.454.CMB.1.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (614)..(614): a, c, t, g, unknown or other
  misc_feature (614)..(614): n is a, c, g, or t
  modified_base (629)..(629): a, c, t, g, unknown or other
  misc_feature (629)..(629): n is a, c, g, or t
tcagcgatcgtatacacgaccggtgctcgatttagtcactcatacagggggaggaactgctcagttaggacccaggacggaaccatggaacgccccagcgcagcttctcttcctcctgctactctggcctcccagataccactggagaagtagtgatgacgcgagtctccagcccacctgtctgtntctcgaaggggaancncccacctnccngcgnggcaggtcagagtgtagcagccgtacttgccgtagtaccgagaccgaagaaccgtggaccgacggtcctacccggaaggtccctaccctcgtacttacgtaagttcgagttcgactactacccaacggaacggccctaactagtaactaccgtacccgagacccgttagtacgaggtcggacgtagggtcggtacgagggaacctagggtacttaccacgtttccacctactanaccgngacctgcctagcaacgtgtagaagtttagtttacgatttaaatttcgtatagtacgacgtagtaataaacgttattaaccgtcgtttaccaacgttcttacggttacgacggtaggaacgtagtccggtaggacttaacgacgtaaacgtgtcggtanacgcgaccgtaagtn

SEQ ID NO: 68973 - DNA, 628 bp, Homo sapiens
  misc_feature: GYAE6OF01EUNU0.51.76.G10.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (327)..(327): a, c, t, g, unknown or other
  misc_feature (327)..(327): n is a, c, g, or t
tcagcgatcgtatacacgaccggtgctcgattttagtcactcatacgaggggagggaactgctcagttaggacccagacggaaccatggaagccccagcgcagcttctcttcctcctgctactctggctcccagataccagtgggagaagttgtgatgacgcagtctccagcccacctgtctgtctctacgaagggaancgccacctctccngcgacgggccagtcgagtagtgtagcagcgtacttacgctaggtaccagtacaacgaaccgtcggaccgacgcctccgacggtcctacctacgtattctagtcgatcgactaccnccgaacgacggtccagtgactaccgtccagcgttagtcaggtcggctaggtcggtgcgatcgtacgttcacgttcgacactactacgacgacgacgtcgtcgacgtacgtagttaacgttaagtttagtttactaacgtttaatttacgttacttagtacgtagtacttaagttaacgtaacgtacgtaccgttcttaccgttacgttccggtttacggaccggtacggaccgtaacggtcggtaaggacgtacgtaacgtaacgtacggtacggtacgtacgtaccgtccgtacgtaccg

SEQ ID NO: 68974 - DNA, 790 bp, Homo sapiens
  misc_feature: GYAE6OF01EY0FW.51.76.G10.1.454.CMB.1.raw
  modified_base (100)..(100): a, c, t, g, unknown or other
  misc_feature (100)..(100): n is a, c, g, or t
  modified_base (382)..(383): a, c, t, g, unknown or other
  misc_feature (382)..(383): n is a, c, g, or t
  modified_base (425)..(426): a, c, t, g, unknown or other
  misc_feature (425)..(426): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (484)..(485): a, c, t, g, unknown or other
  misc_feature (484)..(485): n is a, c, g, or t
  modified_base (506)..(506): a, c, t, g, unknown or other
  misc_feature (506)..(506): n is a, c, g, or t
  modified_base (589)..(589): a, c, t, g, unknown or other
  misc_feature (589)..(589): n is a, c, g, or t
  modified_base (601)..(601): a, c, t, g, unknown or other
  misc_feature (601)..(601): n is a, c, g, or t
  modified_base (626)..(627): a, c, t, g, unknown or other
  misc_feature (626)..(627): n is a, c, g, or t
  modified_base (643)..(643): a, c, t, g, unknown or other
  misc_feature (643)..(643): n is a, c, g, or t
  modified_base (720)..(721): a, c, t, g, unknown or other
  misc_feature (720)..(721): n is a, c, g, or t
  modified_base (773)..(773): a, c, t, g, unknown or other
  misc_feature (773)..(773): n is a, c, g, or t
tcagcgatcgtatacacgaccggtgctcgatttagtcactcatacaggggaggaactgctcagttagacccagacggaaccatgggaagccccccgacgncgacgtacgtccttccttcccttcccttccgtacgtaccttaccgtccgtccgtaccctacccgtaacgtaacctaaccgtacggtaacgggtaaacggtaaggtagtagtacgtacggaccgtcgacggtaccgtaccccgaccgcccgtaccccgttcggttaccgttacggttaccgggttaccggttacccgtaacggggaaaccggaaccggtacccgtaccctcctacccgtacggccgacgggaccgacgtacgtacggtacggtacggttacgnnaccgtacggaccgtaccgttaccgtaccgtacggtaacccgnnaaccggtaccggaaccggaaccgtacggntnaccctacgggtgggcgtaccggtaccnnttcccgtaccgtacgaccttnactacgtacgtacgtaccgtacgtaccgtaaccgaacggtaccgtaccgtacgtacctacgtacccgtaccgtaccgtacggnttacggtacggntacgggtacgggtacggtagggttnnccggtacgggtacgancgtacggtaccgtacctaccgtaccgtaccgtaaccgtaccgtacgtaccgacgtaccgtacgtacgtacgttacgnngtaacgttaagtttaacgttacgttacgttaacgtttaacgttacgttacgnttacgtacgtacgtacg

SEQ ID NO: 68975 - DNA, 866 bp, Homo sapiens
  misc_feature: GYAE6OF01DYT0E.51.76.G10.1.454.CMB.1.raw
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
  modified_base (382)..(382): a, c, t, g, unknown or other
  misc_feature (382)..(382): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccacgtggagaagtagtgatgacgcagtctccagccaccctgtctgtgtcctcgaaggggaacncgcccaccctctccngcagggccagtcagtagtgtagcacgcgtacttcgccgtaggtaccngaacgaacgtaacgtcggaccgacggtcctaccgacggtcctccgtactacttacacgttagtactcgacctacaccgaacgacggacctagacgtactaccgcgacgtaccgtaggtcgnggtagtgtacggtcgggtacggaggtacgtagtacgttccgacttccgaacctctacgtaccgacgtaccgacgttaccgtcggtacgtaacgttacgtaaggtttaaacgtttttcgtttaaacgtttaactttttaaaacgtttttacccgtttacggttaacggtttaaccgtaaccgggtttaaaattaaaacggtttttaaaaccgggtttaaaacccgtttaacccgggggtttaccccggtttaaacccccggttttaacccggtttaaccgggttttttaaacccgggtttaaccccgggggaaaaccggggggttaaacccgggttaaaccccgggttaaggggttacccgggggttaaaccgggttaaacgttaaaaccccgtaaaaaccggggttaaaccccggttaaaagggtttccggggttaaccgggtttaacccgtaaccccggttacttaaacccgggtttaacccg

SEQ ID NO: 68976 - DNA, 809 bp, Homo sapiens
  misc_feature: GYAE6OF01EYSMA.51.76.G10.1.454.CMB.1.raw
  modified_base (213)..(213): a, c, t, g, unknown or other
  misc_feature (213)..(213): n is a, c, g, or t
tcagcgatcgtatacacgaccggtgctcgatttagtcactcatacagggggaggaactgctcagttaggacccagacggaaccatggaactccccagcgcagcttctcttcctcctgctactctggcctcccagactaccacgtggagaagtagtgatgacgcacgtctccacgccctaccctgtcttgtcgtccgtaccggaaggggaaacnccgccctacccgtcctccgtcggccgacgggccagtcgaaggtagttcgtacgcgagtccgtacgttacgacccgttacggaccacgaccgaacgtaaacccgtcgaccgacggtccctacccgacggtcctcctactacttactagtcgtatccgactaccgtaccgacggaccgctacgtcgactaccgtcccgtacggaccgttacggtaggtagggtcggtaacggttgggttccgggtacgttaagggggaacctttaggtcccttacgtacccgttacctaaccccacgttaccgtaccggtaacggtaccgtaaccgtccgtaacgtaccgttacgttaccgtaaggtttaacgttttaccgtttacggttaacttttaagttttacctttaggttaccgttaacgttaacggtacttaaacggttaacttaaccggtttacccgttaccgtttaaccctttaccggttaacgttttaccgggaccgggtaaccgggtaaccgggttaacctacggttaccgaggttaaaccgtaacgtacccgtaaacgtcggtaggtaacgtccccgacgtaccccgtaagttcccg

SEQ ID NO: 68977 - DNA, 563 bp, Homo sapiens
  misc_feature: GYAE6OF01BWY8S.51.76.G10.1.454.CMB.1.raw
  modified_base (198)..(198): a, c, t, g, unknown or other
  misc_feature (198)..(198): n is a, c, g, or t
  modified_base (377)..(377): a, c, t, g, unknown or other
  misc_feature (377)..(377): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttgcctggtaccagcaagaaacctggccaggctcccaggcctcctcatctatgatcgcactccacgaacgggccatgactactcccagccaggttcaggtggcgaggtgggtcgtgggactaggtagttcacttcncacatcagcagcctgctacgtcgtagtagttactttgacttaatttacttactgtacagtactaagttaattaacgttacgtacgttcccgtacctacttacgtttcggaccgtacgggtaaccacggtcgtaggaacgtacgaaccgtaaacggtaacgtcggtacgtacgtcgacctacgtacg

SEQ ID NO: 68978 - DNA, 837 bp, Homo sapiens
  misc_feature: GYAE6OF01DQ2NM.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccacgccaccctgtctgtgtctcgaaggggaanacgcccaccctctcctgacgaggccagtcaggagttgtagcgagcgtaacttgcccgtagggtaacccagccgaacgaaaccgttcgggacccgaaccggtcctccccggaaggtcccttacccacgtacttacgtagtaggacttcggacacctacccgaagaacgggtcccagtacgtactaaccgtccccgaacgtccgtaagggtttcgaaacgggttcggaacggttaacggggtcggggtttaacggaccgggggtaaacgtacgggtaacgggttttacccacccgttaccgtttaaccccgaaccttaaaccgtcggaacccggtaccgtaaccggtcccgggtaccgtacgggttaaccgttaccgttaacggttaacgggttttagtttttacggttaaacccgttttaaattttttaacccgtttacccggttagttaaccgggtaacgttaacgtaaaggttaaacctttaaacggtttaaccgttaccgggttacccctttaaccggtttacctttacggttttccgggaacccgggtaacggtacccggtaaggtacgttacgggaagttaaaccgtaacggtaaaccgtaacggtcgggtacgtagtccgtacgtcccgttaacg

SEQ ID NO: 68979 - DNA, 732 bp, Homo sapiens
  misc_feature: GYAE6OF01AGBGN.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgccgagggccagtcagagtgtagcagcgacttagcctggtaccagcaacgaacctggccaggcctcccgaggcctccgtacatcctatgatcgcactaccgacgaacgggccactgactactccgagtcctaggttcgagtcggcgtagggtcgggtcgtagggaactaggtacggtttccaccgttcctaccgaacctactaccgacgacgaccgtaccgtagacctacgttaccgtaggttaacgttacgttttacggacttttaaacggttttactttaccggttagttaccgtaaggttacgttaaacggttaacttaaaccgttaaccggttacccggttacccgtttaacccggtttaccgtttaaccgggttttacccgggaacccgggttaaaccggggtaacccgtaacgggttccggtaagggttaaacggtaccggttaaaacccgtaaaaccggttacgggttacggtacgggttacccgttacggtacccgtaacccggtttaccgg

SEQ ID NO: 68980 - DNA, 807 bp, Homo sapiens
  misc_feature: GYAE6OF01BDHGL.51.76.G10.1.454.CMB.1.raw
  modified_base (219)..(219): a, c, t, g, unknown or other
  misc_feature (219)..(219): n is a, c, g, or t
  modified_base (561)..(561): a, c, t, g, unknown or other
  misc_feature (561)..(561): n is a, c, g, or t
  modified_base (788)..(788): a, c, t, g, unknown or other
  misc_feature (788)..(788): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctccagtactaccacgtggaagtagtagtgagtacggaccgcgacgtcctccgacgccctacccgtgtctgtcgtacctacggaaggggaaacnccgccctacccgtctccgtcggacgtacgggcctacgtcgaggtacgttgttacgacgaggtccgttacgtttacgccgtacggtaccaacggtacgaacggtaaccgtcggaccgtaacggtccctacccggacgttccctcctactaacgtttacgtacgttacggacgttaccgaccgttaacgaccccggtaacggaacccgggtccctaacgtaacggtaacccttaccccgtacgaccggtccggttaaacggtccggaacggttggaacggttggtacggggttaccgaaggggtaactacgggttcttacctaccgttaccaaccggacttacnccgtaacgtaccgaccgttcggttacgaccgtaacgttacgtaacgtttacgttaagttttacctaacgttttacgtttaacgttcgtagtaaccgtattaacgtttaacttaacggttaccgttaacgttcccgttaaccgtttaccgttacgttaccggttacggaccggttagaaccgttagtcggtaagtaacgtaaccgacgttaaacggtgtacggttacnccggactacgttacttccg

SEQ ID NO: 68981 - DNA, 777 bp, Homo sapiens
  misc_feature: GYAE6OF01CWTHJ.51.76.G10.1.454.CMB.1.raw
  modified_base (116)..(116): a, c, t, g, unknown or other
  misc_feature (116)..(116): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (748)..(748): a, c, t, g, unknown or other
  misc_feature (748)..(748): n is a, c, g, or t
tcagcgatcgtatacacgaccggtgctcgatttagtcactcatacagggggaggaactgctcagttaggacccagacggaaccatggaagccccagcgcagcttctcttcctcctnctactctcggcctcccagactaccacgtggagaagtagtggatgacgcagtcctccagcccaccctgtcctggtctcgtccgaaggggaacncgcccaccctcnccgtgccgagggccagtcagagtgtacgcagcgtacttgccgtggtaccagacacgaactcggacgtacgcctaccgcgtcctccgtaccagttactaacgtgactacgacctaacctaccgaacggtaaaccgggcccctaaatacggtaccttaccggtacccgtaaggtaccccttagggttacccgtaggggtacggtaaccggttcgggttacgggggttaaccgggacggggtaaacgtacgggtttaaaccggtttacccctacgttaccccctaaccgggtaaccttaggtaccccctaaggccgtaaccccggtcccgtaccgggtacccgttaaggttaccggtaaacggtttaagtttacgtttttaacgtaaacgtttaactttttaacgttccgtaccgtaacgttacggttaataaacgttttaagtaaacttccggttaacgttcccgttaccgttagttccggttacggaccgggtaaccgtaccgagtacgaggaacttcgaacgtaacgngtccggtacgacctacgcctaccgttacg

SEQ ID NO: 68982 - DNA, 587 bp, Homo sapiens
  misc_feature: GYAE6OF01A84BV.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccaggggaaanagcccaccctctcctgcagggccagtcagagtgttagcagcgacttagcctgtaccagcagaaacctggccaggcctcccaggcctcctcatacctatgatggctactccacgaacgggcccactgatactcccagccgaggttccaaggtgcaggtgggtctggggacagagttctactctacacctactcagccacgcctgaccgagtactaggtatattttcgactaagtttacttacttgtactagctaagttataaagttacttacgggtcccttaccgttacttaccggttttacggacccgtaacgggggtacctaacgggcgttagggaacggtacgtaaccgaaacggtaacgtacggtcggacttccgggctaaccgtaccg

SEQ ID NO: 68983 - DNA, 718 bp, Homo sapiens
  misc_feature: GYAE6OF01ACJQ2.51.76.G10.1.454.CMB.1.raw
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggaagaagtagtgatgacgcagtcctccagcccacccgtgtcctgtcgtcctccgaaggggaaanccgacccctaccttctcccgtggaccgacggggacccagtacgagtagttaggtacgcgacgtcgtacgttacgccgtacgtaacacggacaaccgtaaccgtggaccgacgtcctcccgaggtcccttcctctattacgttganacttcgacctaccgtaccgaaccggtaccggacctaggataccgtaccgtcccgaggtacccgttaggtccgttagggacggtaccggtgggttaccgggtacggtaggtaaacgcgttaacggttccctaccggttacacccggtaactaccgtacgaccgtaccgaccgtaccgtcgtacgtacgtacgttaagtacgttacgtttatacgtttaattacgttactacgtctaacgtacgtaagtaacgttaacgtacgtaccgttaccgttacccgtactcggtttaccgacgggtaacggacgacgtacggatacgacgtacgtaacggacgttacggtcgtaccgtactaccgtcgttaccg

SEQ ID NO: 68984 - DNA, 694 bp, Homo sapiens
  misc_feature: GYAE6OF01ALNUU.51.76.G10.1.454.CMB.1.raw
  modified_base (194)..(194): a, c, t, g, unknown or other
  misc_feature (194)..(194): n is a, c, g, or t
  modified_base (209)..(209): a, c, t, g, unknown or other
  misc_feature (209)..(209): n is a, c, g, or t
tcagcgatcgtatacacgaccggtgctcgatttagtcactcatacagggggaggaactgctcagttacggacccagacggaaccatggaagccccagcgcagcttctcttcctcctgctactctggctcccagataccactggagaagtagtgatgacgcagtctccagccacctgtctgtgtctcgagggaangccacctctctgcgnggccagtcagagtgtagcagcgtacttgtccgtcgtaccacgcaacgaaccgtggaccaggtcctcccggagccttcctactacttctagtcgagtcgactaacgtacccggaacggtaaccgggtcctaacgtacgtaaacttcccgacccgacggtacccgtacggtttacgacgggttcgggacgtaggggtttcgggtccgtaggggactacggtacgttcctacttcctacacctacgtacacgcacgtactcgactcggtacttaaggtactttagtttacgaacttttaagtttacgttacttaggtactaagtacgtaaagttaacgttacgttaaccggtctaccgtttaccgttacgttacgtttacggggaccgttaaccgggaacgttaacgggacggttagggaaagaaccgttaaaccggaaaccgttacggttagggacccggttactaccggtacccgtacgttaccgg

SEQ ID NO: 68985 - DNA, 649 bp, Homo sapiens
  misc_feature: GYAE6OF01CUAAY.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcaacgaaaccgtggccaggcctcccgaggcctcctcatctatgatgcactccgaagacgggccacgtgatactcccagcctaggttccaggtcggcgtagggtcgggtacgtgggactaggtacgttccactcctacacctatccgagcacgcctgctacgttcgtagtaagttgttttacgaactttaattttaacctttacgttagttactagtaccgtaagttaacttaaacgttaccgttacggttaccctttaacccgttacgtttaaccggttttaccgggacccggtaaaccgggggtaaccaacgggttaccgtaggggaaaccgttaacgttaacccgtaaaacggtacgttgggtaccgtacgtacccgaccgtaccgttaacg

SEQ ID NO: 68986 - DNA, 710 bp, Homo sapiens
  misc_feature: GYAE6OF01AZ230.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctacagttacggacccaggacggaaccactggaagccccagcgcagcttctcttcctcctgctactctggctcccagataccactggagaagtagtgatcgacgcagtctccagccaccctgtctgtgtctcgagggaanagccacctctcctgcagggccagtcagagtgtagcagcgtacttacgtcctgtaccagccaacggtaaccgtggaccacggcctacccgagggtcctaccgtcacttcgttacgtgacttcgcgtaagtacccaacggaaacgggccctaacgtacggtaacttaaccgttaccccgaggtaccgttaacgggtttccggaacgggttcgggtacggtaacggggttcggggtacgttacgggggaccttaggtacgtttacgacctcgtaccgaacctactacgacgtcacgtccgtacgacgtacgtacgtagtacgttagtttacgacgtttaactttacttacgtacgttacgtaagtacgtaagttaacttaaacgttaacgttccggtaccctttacgacctttaacggtttccggaacgggtaccgggtaacctaacggccggttacggtaacgtacgtaacgaaaccggttacgtacggttaccggattcggaacgtcgtacg

SEQ ID NO: 68987 - DNA, 695 bp, Homo sapiens
  misc_feature: GYAE6OF01BQ38H.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagccaccctgtctgtgtctccgaaggggaaacngcccacctctcctgcagggccagtcagagttgtacgcaggcgtacttagccgttaggaccagaccaacgaacccgtcggaccaacgggcctacccgaggtccctccctacacttcgtagtggtactgacctacctccgaaccggtaacgggccctaagtgaaccttcctacccgagtcccggtaggtttaccagggtcggacgtagggtcgggttactacggggactaacggtactttacccaccgttccgtaccaaccgtactaccgacggacctacgtccgtacgtacgtacgttacgtaacgtaagtttacttttagtaactttaaattttaccttagttcgtaatacggtattaacggttaacttaacgtaaccgttaccggttcccttaccgttaccgttacggtttccggaaccggtacgggaaccgtagtacggtaggaactacgttaaaccgaaacgttacgtggtaccggtatcggacctacgtac

SEQ ID NO: 68988 - DNA, 786 bp, Homo sapiens
  misc_feature: GYAE6OF01EJE96.51.76.G10.1.454.CMB.1.raw
  modified_base (209)..(209): a, c, t, g, unknown or other
  misc_feature (209)..(209): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtcctccacgccctacccgtgtctgtacgtctaccggaaggggaaacncgccccacccttcgtccctggacgtacgggccagtcgaggtagttgtagcgagtccgtaacttacgccgtaggtacccgagaccgtaaggtaaacccgtggacccgaacggtccctacccgacgggtcccttaccctacctacgtttacctagttacggaacttccggaccttaacccacccggaaccgggaaccgggtcccctaacgttacgtaaccttacctaccccggaccgtaccgggttaacggttccgtaagggtccgggaggtacggggtttcggggtacccgtaggggtaactacggttaacggtcctacgttaccctcgaacctactacgaccgtcgtaacgtccgtagtaccgtagtcgtaagttagtttaactttgtaaacctttaatttcgtagttaccgtagtaacgtaccgttaaattaacgtaaggttacccgtacgttcccttaagttaccggttacgtttaccggaaccgggttaccggaaagtcgggtacggttaggtaaacgacgttaaaccgaacgttacgggttacggtcgtacgtaccaaccgttcgttaacccg

SEQ ID NO: 68989 - DNA, 737 bp, Homo sapiens
  misc_feature: GYAE6OF01D82XU.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaaggggaaancgcccaccctctcctagcgacggccagtcagagttgttacgcagcgtacttacgccgtaggtaccagaccaacggtaaccgtcgggaccaacggtcctacccggacggtccctcctctacttcgtactcgactcgactaccgtaccgaaccgaacgggcctacgtagaccttaccgacccgacgtaccgtaacggttccgacgggtacggtccggtaaggggttccggggttacggtacggggtaaccgtaacgggtttacggttaaccctaccggttacctacccgtaacccgtattaccggaaccggtacgtaccggttacccgtacgaccggttaacgttaccggttaaggtaacgtttattttacgtaacctttaattttacgtacgttcgttaacagtaactaagttaacgtaacttaccgtaccggtaccttaccgttacgttacggttacggaccggtacgggtaacctagtaccggaaggtactaacgaaacgtaaccgtagttacggcgtaactcgaccctagttaccg

SEQ ID NO: 68990 - DNA, 654 bp, Homo sapiens
  misc_feature: GYAE6OF01A1FY5.51.76.G10.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (406)..(406): a, c, t, g, unknown or other
  misc_feature (406)..(406): n is a, c, g, or t
  modified_base (442)..(442): a, c, t, g, unknown or other
  misc_feature (442)..(442): n is a, c, g, or t
tcagcgatcgtatacacgaccggtgctcgatttagtcactcatacagggggagaactgctcagttaggacccagtacggaaccatggaagccccagcgcagcttctcttcctcctgctactctggctcccagctaccacgtggagaagtagtgatgacgcagtctcagccaccgtgtctgtntcgtacgagggaaancgtccgaccctctcctgcgacggcctaggtcagtagtgtagcgaggcgacttagccgtggtaccagccaacgtaaccgnggacccgtaggcctaccgagtccctcctacgctcgtatgactgcctaacaccgtaacggaacggtcctaagtacgtactaccgtacccgagtcccgtaggttccaggttcgacggtacgggtcggtacgnggtaacgtaggtaccttcgaccgtcgtaacaccgtntacgacgtcgactcctaggcttacgtacgtaagttacgtttacgttagtaaccttttaagtttacttacggtaccgtagtaacggttactaagttaacttaacgttaccgtccgttcttacccgtacgttaccgttcggaaccgttacgggaactacgggtgtacggacgtactaacgaaccgtacgtgtaccgactcctaccgtcgtaacg

SEQ ID NO: 68991 - DNA, 699 bp, Homo sapiens
  misc_feature: GYAE6OF01A24I2.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtcgtctccgaaggggaacacgcccaccctctccgtgccgagggccaggtcaggtagttgttagcagcgtacttacgccgtggtaccagaccgaagaaccctggccgacggcctccaggcctccgtcagtctatcgatcgcactaccacgaacggccatcgactctcccgaagtccgtacggttcgaggtcgacgtagggtcgggtacgtaggactacggtacgttaccgaccttaccgtaccacctagtaccgtaaggccgtaacgtcccgtagtacccgttaggttacgtaaggttaaggttaccgttttaagaaccctttttaaagttttacttttacgacggtttactagtaaccgtttaagttaaacttaaacggttaaccgttaccgggttaccctttaaccggtacgtttaccggtttacgggaccccggtaaagggtaccccgttaagccggttaaggaacggtaacttaaccggaaacgtacgtcggtaacgccgttacaccgtactacg

SEQ ID NO: 68992 - DNA, 702 bp, Homo sapiens
  misc_feature: GYAE6OF01BRU2Y.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (575)..(575): a, c, t, g, unknown or other
  misc_feature (575)..(575): n is a, c, g, or t
  modified_base (674)..(674): a, c, t, g, unknown or other
  misc_feature (674)..(674): n is a, c, g, or t
  modified_base (693)..(693): a, c, t, g, unknown or other
  misc_feature (693)..(693): n is a, c, g, or t
tcagcgatcgtatacacgaccggtgctcgatttagtcactcatacagggggaggaactgctcagttaggacccagacggaaccatggaagccccagcgcagctttctcttcctcctgctactctggcctccagataccacgtggaagaagtagtgatgacgcagtctcagccacctgtctgtctctcgagggaaancgccaccctntcgtgcgacgggcctagtcaggtacgtgttacgcaagtcgacttagccgtaggtacagacaacgaaccgtcggaccacgggcctaccgaacggtcctcgtactactcgttaacgtagtactcgacctacttaacccgaaaggtaacgggtacccctaagttaacgtaacttaaccctacccgtaccggaacccggttagggtttaacaccgggtaggtacggtaacggtttcgggtaacgggttgggaaacctaaggttacgtttaccacgtacctaacctaactacgttacgaacggttccaaccgtactacgtactaacggttacgtagtaacgtttatttacgaacttttaacgtttattacgttntacgtaagtacgtaattaactaaagttaactacggttacctacgttacgtacgttacggaacggtacggacgacgtagtacgtagtaacaaccggtaanacggtacgtacgtagtacncgtagtacc

SEQ ID NO: 68993 - DNA, 780 bp, Homo sapiens
  misc_feature: GYAE6OF01B27R6.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanacgccaccctctcctgcgagggccagtcagtagtgtagcagcgacgttagcctaggaccagacaagaaaccgtggaccaggcctacccgaggtcctccgtacagtctagtgatcgacactaccaacggaacggccacgtagtactacgtcccgaagtccgtaaggtttccaagggtacgggtaccgtaagggttcggggttacgtaggggaacgtaacggtacggtttaccgacctttccgtaacgtaaccctaacgttaccgaaccgtacgaaccggtcccgttacggaccttacggttacttaacggtaaagtttacgtttttaacgacgtttttaaacgttttaacgttttaacgtaggttaccgtaagtaacggttaaacgtttaacgttaaaaccgttaaccggttaccggttaccccgttaacccgtttaaaccggtttaccgttttaccggggaaacccggtaacgggggtaaacccgtaaggtttacgggtagggtaaacggtaaacccgttaacggaaaaaccgggttacggttacggtacggtaacgtccggtaaacccgtaaccgttaccg

SEQ ID NO: 68994 - DNA, 687 bp, Homo sapiens
  misc_feature: GYAE6OF01C7534.51.76.G10.1.454.CMB.1.raw
  modified_base (200)..(200): a, c, t, g, unknown or other
  misc_feature (200)..(200): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccgagcccacccttgtctgtgtctccgaaggggaaancgcccaccctctcctgcgagggccagtcagagtgttagcagccgtacttgccgtcggtaccagcaacgaactcggaccacgcctccgagcctctacattcatgatgcagtccaacgaacggtcccaagtntactancccagccgtagtcgagtggcgagggttcggcgtggaacgtagacgttacgactcccgacaacgtactacgacgccgacgtccgtagaccgttacgtacgttagtaaacgtttatttaccggtaacttttaaagtttaacgttttaacgtacgtacccgttaagtaaaccgtaagtttaaaccttaaaccggtaacggttaccgttaccccggttaacgtttacgtaacccgggtttacgggaaccggtaaccggaaccggtaaacgtcggtaaagggtaacgaaccgttaaccggaaaaccggttacggtacggtacccggtaagttccgaaacccggtactttacccggg

SEQ ID NO: 68995 - DNA, 565 bp, Homo sapiens
  misc_feature: GYAE6OF01A5F48.51.76.G10.1.454.CMB.1.raw
  modified_base (195)..(195): a, c, t, g, unknown or other
  misc_feature (195)..(195): n is a, c, g, or t
  modified_base (422)..(422): a, c, t, g, unknown or other
  misc_feature (422)..(422): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctccagccaccctgtctgtgtctcagggaaangccaccctctcctgcagggccagtcagagtgttagcagcgacttagcctggtaccagcaagaaacctggaccaggtcctcccgaggtcctcctcatctatcgatcgcataccactaacgggccactgatactcccagcctagttcagtgacgtaggtgggtccgtgggactaggacgttacacttcctcaaccacgtcagcagcctgctagtcgtagaagttatttnacttaatttattacgtgttacagtctaattaataacttaacgtacgtcctaccgttacgtacgtttcggaccgtaacgggaaccacgtcgtaggaacgaactaaccgaaacggaacgtacgtggtacgtcgtacgtacgtacg

SEQ ID NO: 68996 - DNA, 848 bp, Homo sapiens
  misc_feature: GYAE6OF01D2WY3.51.76.G10.1.454.CMB.1.raw
  modified_base (198)..(198): a, c, t, g, unknown or other
  misc_feature (198)..(198): n is a, c, g, or t
  modified_base (832)..(832): a, c, t, g, unknown or other
  misc_feature (832)..(832): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtcctcacgccaccctgtctgtcgtcgtacgaagggaancgcccacctctcgtgcgacggccagtcagacgttagtagcagtacgtacgtacgtccgtaggtaacccagaccgaaacggtaaaccgtcggaccgacggtcctacccgacggtccctcccgtactacttccgtagtcgtaacgttcgaccgtaacgtacccgaaacggaaccgggtacctaactacgtaccttaacccgtcccgaacgggttacccgtaggttaccgtagggtaacgggtccggttaagggggtttccggggtaacggtaacggggacttacgggtacgttaccgtaccggttacctaacccgaacctacgtaccgaaccgtaccggtccggtaccgttacggacgtttacgacgttttaaacggtaacgttttacgtttataaacctttttagtttacgttttacgacggttacgaacgtttacgtaaagttaacgttaaaccgtaacccgttacccggtttaaccccggttaacttttaacccgggttaccggtttaacccggggaaaccgggttaccgggaaaacccgttacggggttaaggtaacccggttaaaggtaaccccgttaaaaaccggaaccggttacggttaccggaacccgggtttataaacccccggttntaaccccgggttttac

SEQ ID NO: 68997 - DNA, 746 bp, Homo sapiens
  misc_feature: GYAE6OF01BG0JZ.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacaggggaggaactgctcagttaggacccagacggaaccaatggaagccccagcgcagcttctcttcctcctgctactctggctcccagactaccactggagaagtagtgatgacgcagtctccagccaccctgttctgtcgtctccgaaggggaaancgcccaccctctcctgcaggggccagtcagtacgtgttacgcagcgtacgttagcctacggtacagtcaagtaaccgtggaccgaggtcctcccgaggtcctccgtcacgtctacgtgtaacgtcggacctacgtacccgaacggtaacgggaccctaacgttacgtaacttaccttacccgaaccgtaccggtaaccggttcaacggggtacgggtaccgtacggggttcgggggttaacgttacgggggaaaccttacgggttaaccggtttcccgaaccgtttaccctaacccgtaaccgtagttaccggacgacccgtaacggtcccttaggaccgtaggttacgtaaggtaactttgtttacgacttttaaatttacgttactcggtacgacgtacgttaaggttaataaccgtaacggttccgttaacccttcgttaaccgttcggtttacgggaccggtacggtaacgtacggtccgttagggaacctacgaaaccgtaacggtacgttcgggacgtacgtacgcccgttaattacgg

SEQ ID NO: 68998 - DNA, 702 bp, Homo sapiens
  misc_feature: GYAE6OF01BLLPE.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccactggagaagtagtgatgacgcagtctccagcccaccctgtctgtgtctccgaggggaaangcccaccctctcctggccgagggcccagtcagtgttgttagcagcgtacttagcctaggtaccagcaaggaacctggccaggcctacccgaggtccttcctcacgtcctaatgactcgactacacccaacggaacggccctaactgaacctccgtacccaggtcccgtaggttaccaggtcggtacgtggggtttacgggttccgtacggaccgtaaacggttaccggtttaacccctacgtacttacccaacccgtacgtaaccgacccgtaccgtaacccgtcccgtacgtacgttacggttaccgttaacgtaagtttacgttttaggttaacctttaagttttacctttaacgtgtaccgtaggtaaccttaagtaacttaaccgttaacgtccgtaacccttaccgttaccgtacgtttaccggacccggtagggacctacggcgtaggtaacgtacgtaaccgaaagtacgtagtaccgttgctaacgtcgttaccg

SEQ ID NO: 68999 - DNA, 723 bp, Homo sapiens
  misc_feature: GYAE6OF01AKFTS.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccacgccaccctgtcctgtcgtcctaccgaggggaaacgacgcccaccctctcctgcgacgggccagtcagagtgtagcagcgacttacgcctggtaccagacaacgaaccctggccgaggtcctcccgacggtcctccgtaccactaccgtatgacgtcgacctactacccgaacggaaccgggcctacgtacgacttaccgtaccccgacgtccgtaacggtttcgaagggtcgggccgtagggttacgggtcggtacgggaacgtaggttacgttaaccgtctacccggtacctacccgtacgtacgaaccgccgtaaccgtccgtacggacgttacgtacgtaacgttaacggtttacttttaacggtaacttttaacttttaacgttacggtttacgtacgtaacggtcttaaacggtttaacttaaaggttacccgttacggtacccttaacgttaccgtttaccggttacgggaccggtaaccggtaccgtacgtacgtagggacgtaacgtaacgaaacgtacgtaggtacgtacgacgtactcgtaccg

SEQ ID NO: 69000 - DNA, 795 bp, Homo sapiens
  misc_feature: GYAE6OF01B18F0.51.76.G10.1.454.CMB.1.raw
  modified_base (219)..(219): a, c, t, g, unknown or other
  misc_feature (219)..(219): n is a, c, g, or t
  modified_base (746)..(746): a, c, t, g, unknown or other
  misc_feature (746)..(746): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctccagactaccactggagaagttagtgatgacgcagtcctcagccaccctgtctgtcgtctaccgaaggggaaacacgcccaccctctccgngacgacgggccagtcagtagtgtaagcgaagccgtacgttagccgttaggtaacccaggaccaaacggtaaaccctcgggaaccgtaccgggtaccctacccggaaggttcccgtccccttacgtaacctttaacctaggttaccgtacgttacgaacccgtaccgttaacccccggaaacgggtaaccgggtacccctaaacgttcggttaaacccgttaaaccgcccccggtaaagggtcccccgtttaaggggttacccctaaaggggtttccggggaaaccggttcggggtttacgggggttaaccggttaaccgggggacgtttaaggggtacccgttttaacccgaccgtttacctaaccgaaccccgtaacgttaccgaaacgggtcctacggtacccgtagtaccggtacgttaacgtacgtaaggtttaactttacgtatttaacgtttacgtacgttacgtcagtactaagtaatacgtactcgtccgttacgtacgttacgttcgcgtaaggtacncggtacgatacggaacacgaaacgtaccgtggactagctagccgttacg

SEQ ID NO: 69001 - DNA, 849 bp, Homo sapiens
  misc_feature: GYAE6OF01EL8Z2.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcgagggccagtcagagtgttagcagcgacttagcctggtaccagcaagaacctggaccaggcctcccgaggcctcctcactctagtgatcgcactccaacgaacggccactgatacctccgaacgccgtaggttcaggtcgcgtacggtgggtccgtgggactacggtacgttacgacttcctaccaccgtattccgaaccgtccgtaacggtcccgttacggaccgttaacggttaccttaacgggtaaacggttttaacgttttttaccggaaactttttaaacgttttttaaccgtttaaccgtttaacggttaccgttaaagggtaccgtttaaaacggttaaacgttttaaaacgtttaaaccccgggtttacccgggttaccccgtttaacccccgggtttaaacccgttttaacccgggttttttaaccgggggaaaccccggttaacggggggttaaaacccccgttaaacgggttccccgggtttaaacgggggttaaaacggttaaaccccgggtttaaaacccgggtaaaaaacccgggtttaaacccgggtttaccggggtttaaaccggggtaccccggtttaaacccgggttaacccccgtaaaccccggtttaaaccccgg

SEQ ID NO: 69002 - DNA, 819 bp, Homo sapiens
  misc_feature: GYAE6OF01D39SK.51.76.G10.1.454.CMB.1.raw
  modified_base (430)..(430): a, c, t, g, unknown or other
  misc_feature (430)..(430): n is a, c, g, or t
tcagcgatcgtatacacgaccggtgctcgatttagtcactcatacagggggaggaactgctcagttaggacccagacggaaccatggaagccccagcgcagcttcctcttcctcctgccttacctctggcctcccagactaccacgtggaagaagtaggtgagtgacgctagtcctccacgcccaccctgtctgtcgtcctaccggaagggaaacgaccgcccctaccctccgtccgtgccgtacgggcctagtcgagtgttcgtacgcgacggcgtaacttcgccgttacggaccagaccgaaacgaaccgtccgaccgtacgcctacccgcgtcctcctctactcgtagtcgtacgtcgtaccgtacctaccgaacggaccggtacctaacgtgtaactacccgtaccgacgtaccgttaggtaccgnggtacggcggtaggggtcgggttaccggtcggtaacgtacgttccgttactaccgttcccgaacgtactaccgtacgacgaccgtcgtccgtagacctaggttaactaggtttaacgtttccgttttaacgtaaaactttttacgttttacttaccggtccgttaacgtaacggttaacgttaaacgtttaaccgtaacccgtttaaccgggtccccgggtttaccctttaacccggttacggttttaaccccgggttaacccggggaaaacccggttaacccggggtaaactacgggtttaacgggaaaccgggttaaaccgtaaacccgttaaaccgggtaaacctcgggttaacggtcggtccgtaaacccgcccttacggtccgg

SEQ ID NO: 69003 - DNA, 855 bp, Homo sapiens
  misc_feature: GYAE6OF01CPBXS.51.76.G10.1.454.CMB.1.raw
  modified_base (206)..(206): a, c, t, g, unknown or other
  misc_feature (206)..(206): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagactaccactggagaagtagtgatgacgcagtcctccagcccacccttgtctgtcgtccgtccgaaggggaaancgccctaccctctccgtgccgacgggcctagtccgaaggtagttgtacgcaggccgtacttcgccgtaggtaccngacaacgaaccgtggaccacggcctcccgacggtcctacctactacttcgtatgacgtcactacctaccggaagaccgggtccctagttacgactacctacccgagtacccgtaggttccgaggtcggaacggtcggttcgggtacggtagggacgtacgggttacttacccgtaccttccaaccgtacctaacgttacccggacgtaacccgtcggtccctaacgtcgtaaacccggttggtaaagttaccggttttattttaaccggtaacttttaaacgttttttacgttggtaaccgttacgtaacgttaaacgttaacggttaaaacttttaaacccggtacggtttaacccgttacccccggtttaaacccggtttttaccggtttaacccgggttttaaccccggggtaaccgggttaacccgggggtaaaacccgtaaccggggtttaccgaaacggggttaaaccgttaaaaccggttaaaacccgggtaaaacccggttcggggtttaaccggtacccgggttacccctttaaccggtaaaccccgttaacccgtttacccggg

SEQ ID NO: 69004 - DNA, 789 bp, Homo sapiens
  misc_feature: GYAE6OF01AMDH6.51.76.G10.1.454.CMB.1.raw
  modified_base (204)..(204): a, c, t, g, unknown or other
  misc_feature (204)..(204): n is a, c, g, or t
  modified_base (343)..(343): a, c, t, g, unknown or other
  misc_feature (343)..(343): n is a, c, g, or t
  modified_base (424)..(424): a, c, t, g, unknown or other
  misc_feature (424)..(424): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggctcccagataccactggagaagtagtgatgacgcagtcctccacgcccaccctgtctgtcgtctccgaaggggaaacncgccctaccctcgtccctggaccgacggggcctacggtcaggtaggttagttacgccaggcgttacgttcggccgttggtaccaagaccaagtaaacccgtggaccacggcccgtcccaacgggtcccttcccgtaacncgtttacgttacgtacggtacgtccgtacaccgttaaccgaaccgggtaaccgggtacccctaacgtacggtaacttaccncccggaacggtacccgtaggtttcaacgggtccggtagtacgggtccggggttacgacggggtactacggttacggtttacccaccttacgtaacccaaacctacgtaccgacggaacccttaccggcccgttacggaccgttacggttacgttaaggtaaggtttcgtttaacggttactttaaacgtttacgttagttacgacttactaacgtaaccgttaagtaacgttaccgttacgtacccttaccgttacgttacggtttaccggacggtaaccggggaactacggtacggagttaacggtacctaacggtaaaaccggttggttaccgggacgttaccgacggaccttacggttaccg

SEQ ID NO: 69005 - DNA, 755 bp, Homo sapiens
  misc_feature: GYAE6OF01E2NWK.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagcccaccctgtctgtgtctaccgaaggggaaagacgccctaccctctcctgcagggccagtcagagtgtagcagcgtacttacgccgtggtaccagacgaacgaaacccgtcggaccgacggcctcccgacggtccctcctcactactagtagtactcgacctactacccgaacggaacggccctaacacgtactacctcccgacgaccgtacggttacgacggtcggacggtagggtcgggtacggtacgggacgtacggtacgtttaccgacccttaccgtacctaaccctactaccggtaacgaccgtacggtccccgtacggtcccgttacgttaccggttaagttaacgttttacggtttttacgtaaacttttaaacgtttttaaccgttacgtttaccggttacgaaacgttacgttaaacggtttaacttaaacgttaccggttccgtacccgtttacccttaccggtttaccgtttaccgggacccgggtaacgggtaacccgaacggtccggtaacggaagtaaccgtaaccgtaaacggttacgtacggtacggtaccgtcgacccgtacgttacg

SEQ ID NO: 69006 - DNA, 873 bp, Homo sapiens
  misc_feature: GYAE6OF01BHU8E.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctacgaaggggaaanacgcccacctctccgtgcagggccagtcagtagtgtagcagcgtacttagccgtggtaccagacaacgaaaccgtggaccacggcctacccgacggacctcccgtacattccgtaagtgtaatcgactaactacccgaacggaaccggggtcccaacgttacggtaactaacccgttcccgaaccggtacccgtaagggtttaccgaggttacggacggttaagggttccggggtacgttacgggggaacttaacgggttaacggtttaccaacccgtttccgttaacccaacccgttaacgtaccgaacggaccgtaaccggtcccgtacggaccgttaacgggttaccgtaagggttaaacgtttacgtttttaaccgtaaacgttttaaagtttttaaaccggttttaacgttaaccggtttagtaaacgggtaaccctttaaaaggtttaaaacccttaaaacggtttaaaccggttccgggttaacccctttaaccgggtttaacccgtttaacccggttttaaccgggggaacccgggtaaacccggggggtaaacctaaaccgggttaccggttaacgggtaacggttaaacccgtaaaccgtaaaaaccgggtttaacggtacgggtaaccgggttaccgtaaccggtaaccttaaccggttaaccg

SEQ ID NO: 69007 - DNA, 656 bp, Homo sapiens
  misc_feature: GYAE6OF01AJ6TC.51.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcaggggccagtcagngtgtagcagcgtacttgcctggtaccagcaagaacctggccaggcctcccgaggtcctccgtanatctatgatgacacgtccgaacgaacgggccagtgaactacgtacccgagtccgtaggttccaggtcggacgtagggtcgggtcgtacgggactacggtacgtttaccaccttcgtacccaaccgtacgtaccgacggtccgacgtcccgtcggaccgtagttaccgtaaggtaacgttacgttttagactttaagtttacgttacgtagtaccgtagtactaacgttaagtaaacgttaaccgtccggttacccgttacccgttaacgttaccggtttccggaccggtaaccgggaacctaacggtcgtaggaacgtactaaccggaaacgttacgtggtaccgtacgtcgcccgtaagtaccg

SEQ ID NO: 69008 - DNA, 889 bp, Homo sapiens
  misc_feature: GYAE6OF01EO1NW.51.76.G10.1.454.CMB.1.raw
  modified_base (203)..(203): a, c, t, g, unknown or other
  misc_feature (203)..(203): n is a, c, g, or t
  modified_base (279)..(279): a, c, t, g, unknown or other
  misc_feature (279)..(279): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccacgtggagtaagtagtgatgacgcagtctcagtccaccctgtctgtcgtctaccgaaggggaancgcccacctctaccgtgcgacgggcctagtcgagtagtagttacgctacggcgtactttacgccgttaggtaaccngaaccaagtaaacccgtcggaccgacggtccgtaccccgaggtccctacctctacttactacgtggtactcggacttaccgaccccgaaaggaaccgggtacccaagtttacgaacgttacccgtaccccgaacggttaccgtaacgggtttccgaacggggttgggtaacccggtggggtttaccgggttaccggtacggggtaaccgtaacggggtttaactacccgttaaaccgttcccgtaaccgtaaacctacggttaccccaacgggtaaccgaaccggttccccttacgggtaacccgttagggttaccgtttaaagggttaaacctttttaacgggttttaaccgttaaacttttaaaccggtttttttaacctaaccggttttagaaccgtaagtaccggtttaaatttaacccgtaaaagggttacccgtttacccgtacccggtttaccgttaaccgtttaccgggtttaacgaaaccccgggtacgggtaacccgaaggtttcggaacgggtaaaagttaacccggaaaacccggtaaaccgggttttaaggacccggtttacggtacccgttaaccgtcccggtaaccttacccggg

SEQ ID NO: 69009 - DNA, 749 bp, Homo sapiens
  misc_feature: GYAE6OF01C4VVW.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctccagataccactggaagaagtagtgatggacgcagtcctccagccaccgtgtctgtcgtcgtaccgaaggggaacacgcccacccttctccgtggacggacggggcctagtaccgaaggtacggttacgttaacgacgacggtaccgtacgtttacgccgtaggtaacccagaccaacggtaaccgtcggacccgacggccgtcccgacggtccctacctacgtacgttctagtagacttcgacctaccaccgaacggtacggcctagtactacgtacctcccgagtaccgtacggttacgacgggtcggaccgttaggggttccggttacgggacgggtaacgtacggttcgttacccacgttaccgtacctaccgactaccgaccgtacgaccgtctcggtactaacggttacctaagggttaaccgtttaggttttaccgtaaacgtttaacgtttttacgttacgttaggtacgtaactacgggttaaattaacgttaacggtaccgtcgtttaccccgttaggttaccttacgggttcccggaacggtacgggaccgttaaggcggtacgaactacggtaaaccgtaaggtcgttggacgtcacgtcctaagttccg

SEQ ID NO: 69010 - DNA, 859 bp, Homo sapiens
  misc_feature: GYAE6OF01BOGRE.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccacctctcctgcagggccagtcagtagtgtacgcagcgtacttacggcctaggtaccagcgaacgaaaccgtcggaccgacggcctcccgaggtcctccgtctactctagtgtactcgcctacgtaccacggaacgggccctacgtacgtacttaccgtaccccacggtccgtaacggttaccgaggttcgggtacgtaacgggttcggggttaccggtaggggaaccgtacgggttaccgggtttaccctaaccgtttccgtaacccgtaaccgtaacgttaccgaacggtaccgtaaccggtcccgttacggtaccgtaacggttaccgttaacgggttaacggtttaacgtttttaacggtaacttttaaaacgtttttaaccgtttacgttttaccggttacgtaacggtaacgtttaaaccgggttaaactttaaaccggttaaacccgtttccgggttaaccccgtttacccggtttaacccgttaaccggtttttacccggggaaacccgggttaacggggggtaaacccgttaacgggttaccgggttacgggtaaacgggttaacccttaaaacccggaaaacgggtttaacccggttaacgggttacgggttacccgttaccgggtaccgttaaaccccgtttaacccggg

SEQ ID NO: 69011 - DNA, 703 bp, Homo sapiens
  misc_feature: GYAE6OF01CDD6K.51.76.G10.1.454.CMB.1.raw
  modified_base (201)..(201): a, c, t, g, unknown or other
  misc_feature (201)..(201): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagactaccactggagaagtagtgatgacgcagtctccacgcccaccctgtctgtgtctcgaaggggaaancgccacccgtctcctgcgacgggccagtcaggtgttgtacgcgagcgtacttgccgtaggtaccagacaacgaaccgtggaccaggcctacccgaggtccctcctactactcctagtcgatcgactactaccgaacggaacggccaagtgtaactaccgtacccncggaccggtagttcgaggttcgggacggtaggggttccgggtggtacggggaactagggttaaccgttcctaccttccgtacctacgtacgtaccgacgtaccgtaccggtaccgtaggtaccgttacggttacgtaaggtttaagtttacgtttaagtaccttttaaagttttacttacggttactacgtacgtaacttaaacgttaacgttaaacgttccggtacccgttacccgttaaccgttacgttaccggtttaccgggaccggtaacggtaccgtaggtaccggtaaggaacgtactaacgaacgtagtcggcgtacgcctcgtactccg

SEQ ID NO: 69012 - DNA, 793 bp, Homo sapiens
  misc_feature: GYAE6OF01A7BCS.51.76.G10.1.454.CMB.1.raw
tcagcgatcgtatacacgaccggtgctcgatttagtcactcatacagggggaggaactgctcagttaggacccaggacggaaccgatggaagccccagcgcagcttctcttcctcctgctactcgtggctcccagataccactggagaagtagtgatgacgcagttcctccacgcccaccctgtcgtgtcgtccgtaccggaaggggaaacgaccgcccctacccgtcctaccgtcgaccgtacgggccctagtaccgaggtaggttcgttacgccgaaggccgtaacgttaccgccgttaccggtaccgacgaccgaaacggtaaacccgtcggaccgacggtccctacccgacggtcccttccgtactaccgtacgtacgtccgtagtcgacctacgtacccggaacggaaccgggaccctacgttacgaacgtacctacccgacgtacccgtaggttcgaggtcgcggtagggtcggtcggtacggaactacggtacgttaccgtaccttccgtacctaaccgtacgtcgtaccgacgtcccgtaccgtcgtacgtacgttaccgtaaggttaacgtttacgttttacgaaccgttttaaatttacgtttaccgtattaaccggaacgtaaccgttaaagtttaaaccgtaaacgttacccggttaccgttaccccgttacggttaaccgttacggtttaacgggaccccggttaagggaacccgtaaggtcgtaaggtaacctaaagtaaccgtaaacgtacgtggaccggtactacgactaacgttcg

SEQ ID NO: 69013 - DNA, 799 bp, Homo sapiens
  misc_feature: GYAE6OF01D8EG7.51.76.G10.1.454.CMB.1.raw
  modified_base (143)..(143): a, c, t, g, unknown or other
  misc_feature (143)..(143): n is a, c, g, or t
  modified_base (162)..(162): a, c, t, g, unknown or other
  misc_feature (162)..(162): n is a, c, g, or t
  modified_base (191)..(191): a, c, t, g, unknown or other
  misc_feature (191)..(191): n is a, c, g, or t
  modified_base (789)..(789): a, c, t, g, unknown or other
  misc_feature (789)..(789): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactgganagtagtgatgacgcagtcncacgccacctgtctgtgtctcgagggaancgccaccctctcctgcgacggccagtcagtaggtgttacgcacgccgtacgttacgccgttacggaaccgagaccaaacggtaaacccgtcggaccgacggcctacccggacggtcctcctacctagtctttagtacgtatcgactaccgtaccgaacgaaccggggtaccctaacgttacgaaccttaacccgtacccgaacggtccggtaacggtttacgacgggttacgtacgtacggggttcggttacgggtacggtacgtaggtaacttccgtaacttccgtacctaacctagtccacgggacctacgtccgtacgtaccgtaggttaaccgtaggttaacgtttagttttacctaactttaagttttacgtttacgtttacgttaacgacgtttaaacgacgtttaaacgttaacttacccgggttaaccgttccctttaaccgggtttacctttaaccggggtttaccggggtaaccccgggtaaaacgggtacccgtaagggtttaaccggtaggtaaccgggttaaaccttaaacggttaaaacccggtcgggtttacgggtaacgttcccggtacgtaaccccggttnttaacccggg

SEQ ID NO: 69014 - DNA, 696 bp, Homo sapiens
  misc_feature: GYAE6OF01CWPOK.51.76.G10.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (320)..(320): a, c, t, g, unknown or other
  misc_feature (320)..(320): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggcctccagactaccacgtggaagaagtagtgactgacgcagtctccacgcccaccctgtctgtacgtcctaccgaaggggaaacncgccctaccctcnccgtaggcgacgggccagtcagtagtgtagcagtcgacttgccgtaggtaccngacaagaacctggccagcctccgaggtcctcctgaactctagtnacgtcgcaacctccgaacgtacggacctaggtnactacccgtaccgacgtaccgtaggttacacggttcggacgttaagggtcgggttacgagggtaccctaggttacgtctaaccgtctaaccgactacgtacgcgtacctcggtacctggtacctaaggttacccgtaggttatttaaccgttgtaaaccttaacgttttacttacggacgtacgaacgttaacgtaagttaaacgtaacttaaccgtcggtaccctttaacccggttagtttaccggttaacccggacgggtaaacccggtacgtaaccggtacgtagggaaccctaacgtaaaccgaacgttactcgggtactcggtaccacgtccttaacg

SEQ ID NO: 69015 - DNA, 748 bp, Homo sapiens
  misc_feature: GYAE6OF01AEJS7.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaagcgccaccctctcctgcgacgggccagtcagtagttgtagcgacgcgtacttacgccgtaggtaccagacaacgaaccgtcggaccgtacggcctacccgaggtcctccgtactactctacgtgactcgacactaccgaacgaacgggcctacgtagtaactacctacccgacgtaccgtacggttacgtaggtcggtccgtaggggttcgggttacggtacggggaacgtaacggtacgtttacccgaccgtttaccgtactaaccctacgtaccgacgaccggtaccgtacccgttacgacgttacggttacctaaagggttaacttttacggttttaacgtaaaccttttaagttttacttaccgtttagtaaccgtacggttacttaaacgttaaacgtttaaaccgtaacgttaccgggttaccctttaacccggtttaaccggtttaacggtttaccgggaaccggttaccgggaaacgtaacgggtcggtaacgtacggaacgtaaacgtaaacgttaggtacggtcgactacgtaacctcgttacg

SEQ ID NO: 69016 - DNA, 675 bp, Homo sapiens
  misc_feature: GYAE6OF01D53ML.51.76.G10.1.454.CMB.1.raw
  modified_base (196)..(196): a, c, t, g, unknown or other
  misc_feature (196)..(196): n is a, c, g, or t
  modified_base (343)..(343): a, c, t, g, unknown or other
  misc_feature (343)..(343): n is a, c, g, or t
  modified_base (652)..(652): a, c, t, g, unknown or other
  misc_feature (652)..(652): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggaaanacgcctaccctctcctgcgagggccagtcagagttgttagcagcgtacttagcctgtaccagcaacgaaccgtggaccagcctcccgaggcctcctactatcctagtgtatcgcactaccgaacgaacggtcccaagtcgactaccncccgtacgccgtaggtcctaggtggcgtaggggtcggtcggtagggacctaggtacgttccacgtcctaccaactactacgacgaccacgtccctagtcaacgggtttctaaggttaacgtttacgttttacggacgtttttaagtttaacttttagttcgtaaccgtacgtaacgtaacgtaaccgtaaaccggtaaccgttccggtacccctttccggttaacgggtccggttaaccgggaaccgttaaaccggggacgtaaacgggtaacgtaaacgtaacgaaacgttacggtcgtcgggtaccncgaccgtacctagttcgttcccg

SEQ ID NO: 69017 - DNA, 644 bp, Homo sapiens
  misc_feature: GYAE6OF01BM6IB.51.76.G10.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctacgagggaaacgacgcccaccctctcctgcgacgggccagtcagagtgtagcagcgtacttagccgtaggtaccagcaacgaaccnggcccacggcctcccgaggcctcctcactcgtancgtagtcgacactaccaagacggccagtagactaccgtcccacgtaccgtacggttccacggtggacgtagggtcgggtacgtaggacgtacgacgtttctacgtcctaccacctgtaccgacgtccgaccgtctccgaactagttctaaggaacgtttcgtttagaactttaagtttattacctagtcgtaagtacttaagttaattaacgtaacgttccggtaccttaccgttaacgttccggttacgggtacgaacgggtaacctacgtacggtacgaacggtactaaaccggtaacgtaccgttaggtacggtcctaacgtcctaacccggttac

SEQ ID NO: 69018 - DNA, 706 bp, Homo sapiens
  misc_feature: GYAE6OF01DH4H3.51.76.G10.1.454.CMB.1.raw
  modified_base (196)..(196): a, c, t, g, unknown or other
  misc_feature (196)..(196): n is a, c, g, or t
  modified_base (582)..(582): a, c, t, g, unknown or other
  misc_feature (582)..(582): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggaaancgcccaccctctcctgcgacgggccagtcagtgtgtgacagcgtaacttgccgtagtaccagacacgaaaccgtcggaccacgggcctcccgacggccttacctacctacttccgtatgacgtcactaacgtcccaacggaaccgggacctaacgtacgaacttaccgacccggaacgtccggtaaggttccgaaggtcgggtacgtagggtttccggggttagtacggggtaactaggtttaccggtactaccttccgtaaccaccctattacggacgccgacgtccgtacgacgtagttaccggtaagttacgtttaggtttacctacgttaacttttagttacgtcgtacgtagtaacgtaagtttaaccgtattaacccggngttacccgtttacgtaccgtttacgtttacccgggacgtaccggggtaacctacgggtcggaaggtaactacggtaaccgtaaacgttcgtacgggtactaccgtaccgacttaaccgtttccg

SEQ ID NO: 69019 - DNA, 973 bp, Homo sapiens
  misc_feature: GYAE6OF01BP97Y.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggcctcccagactaccactggaagaagtagtgaatcgaacgcagtcctccacgccctacccgtgtcctgtcgtcctacggaaggggaacacgccctaccttcctccgtgaccgacggcctaggtacaggtacgttggtaacgcgtaacggacgttaacgttccgaccgtacgggttaaccaacgtaccaaaccggtaaaccgcggacccgaggccctacgacggtccctacctactaacttcgtaacgtggtactacgaccgttaaccgaccgaaacggaaccggtaccctaagtagtaaccctaaccgtcccgaacgtacggtaacgttacgcgggtaccgtacggtcggggtacgggttacctacggggtaacgtaacggttacggtttaacccacgtttaccccgttaaacgacccgttaacgtaaccggtacccgtaacgggtaccggttacccgtaaccgggttaaacccgttaacggttaacccggtttaaaggtttaaacggtttttaaccggtttttttaacgaaaaccgtttttttaaaccgttttaaacgttttaacccggttaacgggtttaaaccgttaaccgttaaacggtttaaacgttttaaaaccggttaaaacccggttttaccccgggttaccgtttaaccccgttttaaccccggttaacggttttacccggttaaacgggggaaaccccgttaaacggggtaaacccgttaaacggtacgggttaaacggttaaacgtaaaccccgttaaaaaccgggtaaaccggttaaccggttacggttaacccgggttaacccaacggttaaacccccgtacggttttaaacccggg

SEQ ID NO: 69020 - DNA, 768 bp, Homo sapiens
  misc_feature: GYAE6OF01CFVX2.51.76.G10.1.454.CMB.1.raw
  modified_base (254)..(254): a, c, t, g, unknown or other
  misc_feature (254)..(254): n is a, c, g, or t
  modified_base (350)..(350): a, c, t, g, unknown or other
  misc_feature (350)..(350): n is a, c, g, or t
tcagcgatcgtatacacgaccggtgctcgatttagtcactcatacaggggaggaactgctcagttaggacccagacggaaccatggaagccccagcgcagcttctcttcctctgctactctggcctcccagataccactggagaagtagtgatgacgcagtcctccacgcccacctgtctgtcgttccgtacggaaggggaaacacgcccctacccctcgtcctggaccgacgggccagtcaggtagtgtacgnacgtcgacgttagccgtacggtaccaggacaacgtaacccgcggtaccacggtccctcccgacggtcccttccctactacgttaccgttagtacgngtccgaactaccgtaaccgaaccggaaccgggtacctacgtacttaacacctacccgacgtaccgtaggttccgagggtcgggacgtcggggtacgggttcggacggtaacgtcgtacgttaccacttccacctaccgactacgacgtccgacgtcctacgtaccggtacgttaccgtaaggttaacttttcgtttaacgttactttttaaactttccgttacgttacgtaacgtacgtaacgtttaagttaaccgttaaacgtttacccggtacggtttaccccccttttaggtaacccgtttacgggtttccccgggaaaccggaccggtaaacccggttgtaaccggttaaggaaccgtaaaccgtacggtaaacgttaccggttaggtacgtaccgacgtccgttaacccggta

SEQ ID NO: 69021 - DNA, 682 bp, Homo sapiens
  misc_feature: GYAE6OF01BLRCU.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagcgcccaccctctccgtgcgacgggccagtcagagtgttagcagcgacttacgccgtggtaccagacaacgaaccgtggaccagggcctacccgaggccttccctactatctatcgtactcgacctactacccgaacggaacggccacgtagaacttaccgtcccgacgtaccgtaggttcgaggtcggcgtagggtcgggtacgtagggactagtacgttaccaacctcctaaccgacctacgtcgacggaccgacgtacccgtgtaccgtagttccgtaaggtaacgtttacttttacggaacttttaatttttacgttcgtttacgtacaagttactaagttaaacttaaacgttaccgtccgttacccgttaaccgttactttaccggttaccggaacccgggtagggtaaccctacggtcggtagaacgttaacgtaaaccgaaacggttcgtggtacccggatacccgaaccgtcttacg

SEQ ID NO: 69022 - DNA, 773 bp, Homo sapiens
  misc_feature: GYAE6OF01EXE0O.51.76.G10.1.454.CMB.1.raw
  modified_base (200)..(200): a, c, t, g, unknown or other
  misc_feature (200)..(200): n is a, c, g, or t
  modified_base (555)..(555): a, c, t, g, unknown or other
  misc_feature (555)..(555): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgggagaagtagtgatgacgcagtctcagccaccttgtctgtgtctaccgagggggaaacncgcccaccctctaccctgcgaggggccctaagtcaggtagttgttagcaggcgtactttagcctggtaccagcgaagaaacccgtggaccgaacggcctacccgaaggtcctccctactattacctatcggtatcggcctacttacccgaacgtaacgggccctaacgttcggtaacttacctcccgaacgtaccgtagggtttaccaaggtcggggtacctacgggtttacggggtaccgttaggggaaccttaacgggtacgtttaccaccgttccttaaccgaaccctataccggtaagccgtaacgggtccctagggtaccgtacggtttaccgtaaggttaacgggtttntttttaacggacttttaaagttttaacgttccgttacgtacgtaagtacgttaaaggttaacttaacgtttaaccggtcggttaacccctttcggtaacctttacgtttaccgggaaccggtttacgggaaccgtacgggtctaaggggttaacaccggttaaacgtaaaccggtacggttagggttaccggagttaaccggtcctaaccgtttacgg

SEQ ID NO: 69023 - DNA, 659 bp, Homo sapiens
  misc_feature: GYAE6OF01AFVJB.51.76.G10.1.454.CMB.1.raw
  modified_base (640)..(640): a, c, t, g, unknown or other
  misc_feature (640)..(640): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagcgccaccctctcctgcagggccagtcagagtgttagcagcgtacttagcctggtaccagcaagaacctggccaggtcctcccgaggtcctcctcgtatctatgatcgcactccaacgtacgggccctacgtgactaccgtacccacgtccgtacggttcgaggtcggacgtagggttcgggtaccgtgggaactaggttacgttccaccgttaccaccgtaacctacgtcgacgtccacggtccgagacgtacggttacgaaggttacgtttatttagtaacctttaactttacgtaccgttcgtaacacgtattaacgtaaacttaccgtaccggtccgttacccttacgttacgttaccggttaccgggaccggtaaccgggtaactacggtacggtaggaaccgtaacgtaacccgtaaaagtcggttacgggaccgtanaccgtacctaccgttaccg

SEQ ID NO: 69024 - DNA, 773 bp, Homo sapiens
  misc_feature: GYAE6OF01CA1K1.51.76.G10.1.454.CMB.1.raw
  modified_base (203)..(203): a, c, t, g, unknown or other
  misc_feature (203)..(203): n is a, c, g, or t
  modified_base (298)..(298): a, c, t, g, unknown or other
  misc_feature (298)..(298): n is a, c, g, or t
tcagcgatcgtatacacgaccggtgctcgatttagtcactcatacagggggaggaacctgctcagttaggacccagacggaaccatggaagccccagcgcagcttctcttcctcctgctactctggcctcccagactaccactggagaagtagtgatgacgcagtctccagcccacctgtctgtcgtctacgaagggaaacgngcccaccctctcctgcgacggccagtcgagtacgttgtagccgagtcgtaacgttcgcccgttacggtaccacggacctaacggtaaaaccccgngggacccgtaacggccctaccccgacgggcccttaccccttaccgacgtttctaagttcgacgttcgacctaccgtaaccccaaacggaacgggtccccaacgttacggtaaccttaccctaccccggaacgtacccgtaggttaccgagggttcgaacggttcggtcgggttagtcggggaaacgtcggttaaccgttaccgtaccttacctaccggtacctacgtacccggaagtcccgaacgtcccgtacggtccgtacggttaacgttggtaaactttacgtttacgttaacttttaactttacgtttactcgttaagtctaactaacgtttaacgaacgttaccggtccgttaccctttacccgtacggtttacgtttaccggggaccgtaacccgggaacgtacggtcggtaaaggtacgtaacaacggtaaaccgtggtacggtacgtactaccgactaccgttaccg

SEQ ID NO: 69025 - DNA, 783 bp, Homo sapiens
  misc_feature: GYAE6OF01BFOJG.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccttgtctgtcgtctcgaggggaancgcccaccctctccgtgcgacgggccagtcaggtagttgttacgcgagcgtacttacggccgtaggtaccagaccaacggtaaacccgtcggaccgacgggtcctacccgacggtcctacccgtacgtacttaccttagtcggacgtcgacctaccgtacccgaacggaacgggtccctaacgttacgtaaccttaccgacccggtaaccgtaccggttaacggttaccggtacgggttccgggacgtacggggtttaccggggtacggtacggggtaaccgtaggtaccgtttaccgtacccgtaccctacccgtaccgtaacgtccgtacgtccgtaacggtccgtacgtacgtacgttacgttaaggtaacgttacttttacgtacttttaatttacgtttacgtacgtacgtaagtacgttaagttaacgttaacgttacgttccggttacccgttaacgttaccgtttacgttaccgggaaccggtaccgggtaaccgtaacggtccggtaaggtaccggtaacgtaaaccgtaacggtaacgttaccgggacgttaccgtaaccgtccgtccgttaacgg

SEQ ID NO: 69026 - DNA, 918 bp, Homo sapiens
  misc_feature: GYAE6OF01DGT0N.51.76.G10.1.454.CMB.1.raw
  modified_base (170)..(170): a, c, t, g, unknown or other
  misc_feature (170)..(170): n is a, c, g, or t
  modified_base (208)..(208): a, c, t, g, unknown or other
  misc_feature (208)..(208): n is a, c, g, or t
tcagcgatcgtatacacgaccggtgctcgatttagtcactcatacaggggaggaactgctcagttaggacccagacggaaccatggaagccccagcgcagcttctcttcctcctgcttactctggcctcccagactaccactggagaagtagtgatgacgcagtcctccngcccacctgtctgtcgtacgtaccggaagggggaaacncgccctacccgtctcccgtggaccgacgggcccaagtccgaaggtacgttagttacgcaggtaccgtaacgttacgccgtaggtaacccaggacctaacggaaaccgtcggacccgtacgggtaccctccccgaacggtcccttacccgtactacgttaccgttaacgtacgtacgttacggaacctaacctacccgaaacgggtaaccgggacccttacgtacgtaactaccgtacccggacgtacccgtaggttaccgtaggtcggacggttagggttacgggtcggtacggtacgtaacgggttacgttacctaccttccaacccgtaacgtacgtaccggacgtaaccgtaccggtccctaggtacccgttaaggttacgtaacggttaacgttttacgttttaaccgtaaacttttaacgtttttaacgtttaccgttacgggtttaaccctaaggttaacccgttaagtttaaaaccgtttaaaccgttaccggttacccgggttaccccgttttaacccggttacccgttttaaccgggttttaccccggggaaacccgggtaaccggggtaacccgttaaaccgggtccgggttaaacgggtaaccggtttaaaaccgtaaaccccgggttaaaaacggttacccggttaacggggtaaccggtttaccccgtaaacggtaccccttaaacggtttacccgg

SEQ ID NO: 69027 - DNA, 749 bp, Homo sapiens
  misc_feature: GYAE6OF01CO1LF.51.76.G10.1.454.CMB.1.raw
  modified_base (210)..(210): a, c, t, g, unknown or other
  misc_feature (210)..(210): n is a, c, g, or t
  modified_base (386)..(386): a, c, t, g, unknown or other
  misc_feature (386)..(386): n is a, c, g, or t
  modified_base (472)..(472): a, c, t, g, unknown or other
  misc_feature (472)..(472): n is a, c, g, or t
  modified_base (520)..(520): a, c, t, g, unknown or other
  misc_feature (520)..(520): n is a, c, g, or t
  modified_base (737)..(737): a, c, t, g, unknown or other
  misc_feature (737)..(737): n is a, c, g, or t
tcagcgatcgtatacacgaccggtgctcgatttagtcactcatacagggggaggaactgctcagttaggacccagacggaaccatggaagccccagcgcagcttctcttcctcctgctactcgtggcctcccagataccacgtggaagtaagtagtgatgacgcagtcctccacgcccaccctgtcttgtcgtcctaccgaaggggaacncgaccctacccgtctcccgtggaccgaacggggtaccctaggtacgaaggtacggtttacggttaacggccgtaaacggtccggtaaccgtttacggacccgttagggtaacccgaggaccgtaaacggaaacccgtcggaccgacggtaccctcccgagtccctcgtctacgttntatgactcgacctaccgtacgaccgaaggtcccagtacgactactcccgagtccgtagttcgaaggtcggagtgggtcggtacggnggtaactcggtacttccgacttaccgaccgtactacgtcgacggtacncggtactacggtaccgtagttacgttaaggtacgttttacgttacgttaactttaattttacgtacgttcgtacgaaggttactaaggttaaactaacgttacgtaccgttaacctttaaccggttacttccggttacggaaccgggtacggaacgtccgggtaagtaggtaacgggtactaaacccggtaacgttcgcggtaacgtccgtaacgtnaaccgtttaccg

SEQ ID NO: 69028 - DNA, 823 bp, Homo sapiens
  misc_feature: GYAE6OF01DSHRW.51.76.G10.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccaccctgtctgtgtctcgaggggaancgcccacctcncctgcgacgggccagtcagtagttgtagcagtcgacttcgccgtaggtaccagacaacgaaaccgtcgggaccctaacgggcctaccccgaggtcccttcccgtactacttccttaatcgactcggcctaacctacccgaacgaccgggaccctacgtacgtactacctcccgagaccgttaggtcgaggtggacgtagggtgggtacgtacgggaactagggtacgttccaacttccgtaccaacctactaccgacggtacctacggtcccgttacggacctaacgggttcctaagggttaaacgttttacgtttttaaccgggaaactttttaaacgttttttaaccgttaacgtttacggttaaccctaaggttaaccgttaaagttttaaactttaaaaccggtttaacccgttaccgggttacccccgttttaacccgggtttaaccggttttaacccgggtttttccggggaaacccgggtaaccgggggtaaaacccgtaaccgggttaccgggtaagggttaaaccggtaaacccgttaaaaccggtaaaaccgggttacggtttacggtacgggttaccgtaaccgtacccgttaaccgttaacccg

SEQ ID NO: 69029 - DNA, 915 bp, Homo sapiens
  misc_feature: GYAE6OF01EOZ5T.51.76.G10.1.454.CMB.1.raw
tcagcgatcgtatacacgaccggtgctcgattttagtcactcatacagggggaggaactgctcagttaggacccagacggaaccagtggaagccccagcgcagcttctcttcctcctgctactctcggctcccagataccactggagaagtagtgagtcgacgcagtcctccagcccacctgtctcgtcgtctaccgagggggaacacgcccacccttctccgtgccgacgggtaccacggtacagggttagttacggttcgaccgtaggaccggttaactttaacggaccggtttacgggttaccgaacggaccgaaacggaaaccccggtcgggaccccgagggtcccctacccggacggttccctacccttacgtaaccttactacgtacggtactcgaactacccgttaaacccaacgggtaaacccggtacctaacccggtttataaaccttcccctaccccgggtaaccgttcccgggttaaacggttaaccgtaaggggtcccgtaagggtttacggggttccggttacgggtaccggtaaacggttacgtttacccgttaccgtaccccttccgtaacccgaccttacgggtacccgtaacgtaccgtacccgtacggtacggtaacccggtttacggtacctaaagggttttaactttacgtttaaacgttattttaacgttttaaccgttaactttacgggaaccctaaggttaacgttaaacgtttaaccttaaacggttaaccgtcccgtttaaccctaccggttttaaccggttacccgggttaccgggaaacccgggttagggtaaaccccgttacgggcgttaaaccggggttactaaaccggtaacgtaaacgtttcccgaagggtttcccgacgtttacgaacccgtcctttaacggg

SEQ ID NO: 69030 - DNA, 763 bp, Homo sapiens
  misc_feature: GYAE6OF01EEDS8.51.76.G10.1.454.CMB.1.raw
  modified_base (390)..(390): a, c, t, g, unknown or other
  misc_feature (390)..(390): n is a, c, g, or t
  modified_base (606)..(606): a, c, t, g, unknown or other
  misc_feature (606)..(606): n is a, c, g, or t
tcagcgatcgtatacacgaccggtgctcgatttagtcactcatacaggggaggaactgctcagttaggacccagacggaaccatggaagccccagcgcagcttctcttcctcctgctactctgctcccagataccactggagaagtagtgatgacgcagtcctccagcccacccttgtctgtcgtctccgaagggggaaacacgcccaccctctccctggcacggggccctaagtcgagagttgtacgcagcgtacttagcctaggtaccagaccacgaaacctcggccaggtcctcccgaggtccctcccgtactaacttctacgtggtaacttcgaacctacgtacccgaaccggtaaaccgggtacccgtaaacgttcgttaaccgnttaaaacgggtttcccccaaggtttacccggacgttacgtacgggttacggtacgggtaccgggttggggaccgttaggggaaacccttaggtaaccggtttaaccctacgttacccctaactaccctaacggttacccaacgggccgtaaccggtcccgttacggaactggtttaaccggatttaaacgttactttaacgttacgtttaactttnttacgttagtaccgtaagtaaccgtaagtttaaactaacgtacgttccgttacctaccggttacggttacttacgggacccgtaaagggacctacgggtactaagggtacctacgtaaccgtagaccgttaggaccgtcgttaccgtacgttacccg

SEQ ID NO: 69031 - DNA, 733 bp, Homo sapiens
  misc_feature: GYAE6OF01B367I.51.76.G10.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaacngccaccctcgtcctgcagggccagtcagtagtggttagcgagcgtacttagcctggtaccagcaagaaacctggccaggcctccgaggcctccgtanatctagtgatcgcctataccacgaacgggtcccacgtcgactacctacccgaacgtccgtaggttccgaggtcggccgtaaggtggggtaccgtagggactagggtacgttcctaccttccgtacctaaccgtacttaccgaacgccgaacggtcccgttacgcgtaacggttcgttaaacgggtaacgttttacgtttttaacggacttttaaaagtttttactttaacccggtttggttaacccgtaaggtccgtttaaaacggttaaattaaaacccgggtttacgtaccccggggttacccctttaaaccggttaccttttaaccgggttttccggacccgggtaacggggtaacccgtaaggtccgttaaggggaaacggttacctaacggaaaaccgttcggttaggtaccgggtcttacgccctaacgttac

SEQ ID NO: 69032 - DNA, 823 bp, Homo sapiens
  misc_feature: GYAE6OF01CD2QC.51.76.G10.1.454.CMB.1.raw
  modified_base (153)..(153): a, c, t, g, unknown or other
  misc_feature (153)..(153): n is a, c, g, or t
  modified_base (474)..(474): a, c, t, g, unknown or other
  misc_feature (474)..(474): n is a, c, g, or t
  modified_base (568)..(568): a, c, t, g, unknown or other
  misc_feature (568)..(568): n is a, c, g, or t
tcagcgatcgtatacacgaccggtgctcgatttagtcactcatacaggggggaggaactgctcagttacggacccagacggaaccatggaacgccccagcgcagctttcctcttcctctgctactctggcctcccagactaccacgtgggaanaagttgtgagtgacggctacgtcctccgacgccctacccgtgttctggtcgtccgtaacggaacgggggaaactccgcccctacccttcgtccgtagacgacgggcctaggtcgaaggtagttacggtacgaccgacggtaccggtaacgttccggtcccggttcggtaacccgaacggtaccgaaacccgggttaaaccgccgggacccgtaacgggtcccctaccccgggtaagtcccccttacccttaagtacttacgtttagacgtactcgacctccgaaacgtacgggaccgtactagtactacgtaccctaccgnggttaccgtaggttacggacggtcgggacgtttacggggtggttccgggaacgtacggtacgtttacgttacccctaccgtttcaacccggtanaccgtcaacgtcctacgtcgtacgacgttcgtaacgttacggttaacttttacgttaagtttaacctttagtttaccgttacgtacggttactagtaacgttaacgttaacttaacgttaccggttacccgttaccgttacccggttactttaacgggtaccggaccgggtaccgtaacggtacggtacggttacggtaactaaccgtaaccggtaacgttacggtcgtacggtaccacggttcctacgttaccg

SEQ ID NO: 69033 - DNA, 687 bp, Homo sapiens
  misc_feature: GYAE6OF01B3RHY.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcaggccagtcagagtgttagcagcgacttagcctggtaccagcagaacctggccaggctccagctcctcatctatgatcgcatccacgacgggcctactgatactcccagcctaggttcaaggttcggacgtagggttgggtacgtggggaacctaggtacgttcctaaccttccgtacccaacctacgttccgaacgtccgaacggtcccgtcgaccgtacgttcgttaaggtaaagtttacgtttttacggaacctttaaacttttttacgttaaccgtttgtaaccgtacggttaaccgttaagttaactttaaacgttaaccgttcggttacccctttaacccggttaaccgtttaccggttttacccggacccggtaacgggggtacccaaacggtcggttaacgggtagttaaccgtaacgtaaaaccggttaacgttcggtacggtactacggcccgtaacccgttaccg

SEQ ID NO: 69034 - DNA, 708 bp, Homo sapiens
  misc_feature: GYAE6OF01ANHGE.51.76.G10.1.454.CMB.1.raw
  modified_base (209)..(209): a, c, t, g, unknown or other
  misc_feature (209)..(209): n is a, c, g, or t
  modified_base (260)..(260): a, c, t, g, unknown or other
  misc_feature (260)..(260): n is a, c, g, or t
  modified_base (385)..(385): a, c, t, g, unknown or other
  misc_feature (385)..(385): n is a, c, g, or t
  modified_base (680)..(680): a, c, t, g, unknown or other
  misc_feature (680)..(680): n is a, c, g, or t
tcagcgatcgtatacacgaccggtgctcgatttagtcactcatacagggggaggaactgctcagttacggacccagacggaaccatggaagccccagcgcagcttctcttcctctgctactctggctcccagataccactggagaagtagtcgatgacggctagtcctccacgcctaccgtgttctaggtgtcctacgaggggtaaacncgtcccaccctcgtcctggcgacggggtaccagtcgagtacgttggttacncgaagtccgtaacttcggccgttaggtaaccacggtacaacggtaaccgtcggacacggtacctccgaacggtccttcccatacgtactacgtacgtactcgacacgtaccgaacggaaccggtnaactacggtactaaccgtccgtaacgcgttaacggtcgaaggttccggacgtacggtacggggttacgacggggtaactacgtaacggttaccctaacggtcttaacccaccgtacgtaccggtacgaaccggtacgtcctagtaccgttacggtacctaaggtaacgttacgttttacgtaaacgtttaactttacgtaacggttctacgtacgattaacgaacttaacgtaacttccggtctaaccgtattaacggttcgacgtaccgggactacgtgtacgaagtacgtaanaacgtacgtcgtacactacgcgtctacg

SEQ ID NO: 69035 - DNA, 676 bp, Homo sapiens
  misc_feature: GYAE6OF01B4XOI.51.76.G10.1.454.CMB.1.raw
  modified_base (194)..(194): a, c, t, g, unknown or other
  misc_feature (194)..(194): n is a, c, g, or t
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctcaggggaaangccaccgtctcctgacagggccagtcagatgttagcagcgacttaggcctggtaccngtcagtaaactggaccaggtcctcccaggcctacccgtnacttctatgatcgcactccgaacaagggccacgtcgaactactcccgaagccgtaaggttcaaggttcggcaagggttcggccgtgggacaggtacgtttcaacgttcctacgaccagtcgacgccaggtcctaggacctaggtacctagtaagttacgttttaacgacgtttaaacttttactttaaacgttcgttaacgtacgaacgttaagttaaacttaaacgttaaccgttacgggttaaccccgttaaccggttacccttacggttttacccgggaaaccgtacgggggtaaaaccctagggtaccgtagggaacggtaacttaaacccggaaacggttaaccgttcgggtaacgtaggtacgtaacccgccgttaacgg

SEQ ID NO: 69036 - DNA, 814 bp, Homo sapiens
  misc_feature: GYAE6OF01BXGVX.51.76.G10.1.454.CMB.1.raw
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
  modified_base (463)..(463): a, c, t, g, unknown or other
  misc_feature (463)..(463): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtcnccagcccacctgtctgtcgtctaccggaaggggaaancgcccaccctcgtccgtgacgaggccagtcgagtagtgtacgcagtacgtactgaccgtggtaaccagacaacggaaccgtcggaccgacggtcctacccgagtccctccgttanacgttactagtcgactcacgtacacccaaggaccggtctagtactacgtaccgtacccgaggtaccgtacggttcagggtcggacggtacgggttagggtccgtaagggaccgtaagttcgttaccacgttccgtaccaaccgtanccggtacgacgtacccgtaccggtagtaaccgtacgttaaccggttaggttacttttaaccgtttacggttaaaccttttaaacgttttcgtttaaccgaagggtttaacgtaaccggttaaaccgttaaggttaaaccttaaacccggtttaacgtaaccccgggttttccccgtttaaaccggtttaaccgggttaacccgggttttaccgggggaaaaccccgggtgggttaaaaaccccgaggggtttaccccgtaaagggggtaaactaaacccttaacccgggttaaaacccggttgggttaacccgggacgttacccggttacacccgggttaaacttacccgg

SEQ ID NO: 69037 - DNA, 688 bp, Homo sapiens
  misc_feature: GYAE6OF01DLGHO.51.76.G10.1.454.CMB.1.raw
  modified_base (341)..(341): a, c, t, g, unknown or other
  misc_feature (341)..(341): n is a, c, g, or t
  modified_base (392)..(392): a, c, t, g, unknown or other
  misc_feature (392)..(392): n is a, c, g, or t
tcagcgatcgtatacacgaccggtgctcgatttagtcactcatacagggggaggaactgctcagttaggacccagacggaaccatggaagccccagcgcagcttctcttcctcctgctactctgcctccagactaccacgtggaagtaagtagtgatcgacgctagtcctaccacgtcccctacccgttgttcctggtacgtccgtacggaaggggaacgacgtcccctacccgtcctccgtaggaccgacgggacctagtcaaggtagttgtagacgacgtacgtacctggccctaggtaccagacaacgaaccgtgccgaggcctccggagtccttccnacttctacgtgactcgacactaccgaacgacggtccctaagtgacctaccnccgacgcttaggttcagggtggacgtacgggttcggaggtcggactaaggttctaccgaccttcccgtacaaaccgtactacgacgaccgtacgtccgtagtacgtacgtacgtaagttacgtttacgtttacgtaactttaacgtttacgtttacgtacgtaacgttacggaatttaacgtaacttaacgtacgttaccgtccgttaccttacgttaccgttacgaacggtacggacgtacggtcgtagtaacgtacgaacgtactaacggtcgtaacgagacgtacgagtaccg

SEQ ID NO: 69038 - DNA, 795 bp, Homo sapiens
  misc_feature: GYAE6OF01A0Z4B.51.76.G10.1.454.CMB.1.raw
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctcagccacctgtctgtntctcgagggaaancgcccaccctctcctgcgacggccagtcagtacgttgtagcagcgtacttagcctcggtacacgacaacgaaccgtcggaccacggtccctaccgacggtcctccgtactactctagtcggtactacgaccactaccgaaccggtaaaccgggcctaaccgtacggtaacttacccgtacccgaacggtacccggttaaacggttcgaaacgggttcgggacgtaaggggtttccggggttacgtacggggggtaaacttacgggtaccgtttaccaaccgtttcccgtaaccgtaaccgtacttaaccgacgtacccgtacggtacccgttagtaccgttaacgttacgtaaggttaacgtttacgttttacgttaaccgtttaacgtttttaacgtttacgttaggttaccgtaacgtaacgttaaacgttaaacgtttaaacggttaaccggttaccggttaacccctttaaccggttacccgtttaaccgggttttaccggaaccgggttacgggtaaacccgtacggtaccggtaggtaacgtacttaaacggaaacgttacggtacggtcgtacgtaccgtccgtaccttaccgg

SEQ ID NO: 69039 - DNA, 677 bp, Homo sapiens
  misc_feature: GYAE6OF01BKRW5.51.76.G10.1.454.CMB.1.raw
  modified_base (113)..(113): a, c, t, g, unknown or other
  misc_feature (113)..(113): n is a, c, g, or t
  modified_base (221)..(221): a, c, t, g, unknown or other
  misc_feature (221)..(221): n is a, c, g, or t
  modified_base (531)..(531): a, c, t, g, unknown or other
  misc_feature (531)..(531): n is a, c, g, or t
  modified_base (571)..(571): a, c, t, g, unknown or other
  misc_feature (571)..(571): n is a, c, g, or t
  modified_base (646)..(646): a, c, t, g, unknown or other
  misc_feature (646)..(646): n is a, c, g, or t
tcagcgatcgtatacacgaccggtgctcgatttagtcactcatacgaggggagaactgctcagttaggacccagacggaaccagtggaacgccccagcgcagcttctcttccncctagctactctggcctcccagactaccacgtgggaagaagttagtgatggacgctagtcctaccacgccctacccgttgttctgtcgttaccgacggaaggggaaanccgcccctacccttcgtccgtggacgacgggtccagtacgagtgtacgtacgcaggccgtattacgccgtaggtaccagacgtaacgtaacccgtcggccgtaacggtccctacccggaacggtcccttacgtacgtaattccgtagcgtagtcggactaccgtacgaacggaccgtcactaagactaccgaccgtacgtacggtagtacgaggtcgtaacgtcgggtacggtacgtaaggtaccgtagtccttacgacttaccgaaccttacaacgtacgacgtacgtaacgttccgatacgtaacgtntaagtacgtttaattactaactttatttccgtagtacgtntaagttctaaggttaacctagttacgtaccgttaccgtacgttactcggttaacgcggtacgaaacgtgacgtanacgtacactaagtcgtagcacgtcactcgtc

SEQ ID NO: 69040 - DNA, 691 bp, Homo sapiens
  misc_feature: GYAE6OF01BL63L.51.76.G10.1.454.CMB.1.raw
tcagcgatcgtatacacgaccggtgctcgattttagtcactcatacagggggaggaacgtgctcagttaggacccagacggaaccatggaagccccagcgcagcttctcttcctcctgcctactctggctcccagataccacgtggagaagtagtgatgacgcagtctcagccaccgtgtctggtgtctccgaggggaacagcccgacctctccgtgccgagggccagtcgagagttgttacgccagcgacttacgccgtggtaccagcaacgtaaccgtggaccaggcctacccgaggccttaccgtcatctatgactgcactaccagtacggccagtagactactcccgagcccgtagttcgagtgcgtagggtcgggttgacgggactaggtacgtttccaccgttacctaccaaccgtacgttacgaaccgccgtaacccggtcgttacgaccgtttacgtacgttaaggttagtttaacgtttttcggaacttttaactttttaacgttaccttagtaaccgtaaggactttaaggttaaacttaaacggttaaccgttccggttacccgttaaccgtttaccgtttacgtttcgggaaccgtaccggggtaaccagggtcgtaggtaacggtacttaaccggtaaaacgtcgttacggtaccgtaacgtcgaccctggtttaccg

SEQ ID NO: 69041 - DNA, 687 bp, Homo sapiens
  misc_feature: GYAE6OF01BWGT4.51.76.G10.1.454.CMB.1.raw
  modified_base (201)..(201): a, c, t, g, unknown or other
  misc_feature (201)..(201): n is a, c, g, or t
  modified_base (439)..(439): a, c, t, g, unknown or other
  misc_feature (439)..(439): n is a, c, g, or t
  modified_base (473)..(473): a, c, t, g, unknown or other
  misc_feature (473)..(473): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagtaagtagtgatgacgcagtctccagcctaccctgtctgtgtctaccgaggggaaancgcccaccctctccgtgcgacgggccagtcagtagtgtacgcaggcgtacttagcctaggtaccagccgaagaaccctggcccgagggcctcccgaggtcctaccctctacgtctagtcgagtcgaccacgtaccaacggaaccgggtcctaacgtacgtactactccccgagtaccgtaacggttccgaagggtcggtaccgtagggtcggggtctacggggactagtacgttaccnccttccgtaaccgacctacgacgtacgacgtacncgtacgacgtacgtacgtaggtaagtttactttacggatttaagtttacgttacttacgtagtactacgtagttaacttaacgttaccgttacggttaccccttacgtaccgttacggtttacggtaccgggaccgggtaaccgtaggtaccgtagggtacgtactaaccggtaaacgacgttacggtacggtacctcgtacccgtacgtaccg

SEQ ID NO: 69042 - DNA, 789 bp, Homo sapiens
  misc_feature: GYAE6OF01EW634.51.76.G10.1.454.CMB.1.raw
  modified_base (771)..(771): a, c, t, g, unknown or other
  misc_feature (771)..(771): n is a, c, g, or t
  modified_base (776)..(776): a, c, t, g, unknown or other
  misc_feature (776)..(776): n is a, c, g, or t
  modified_base (782)..(782): a, c, t, g, unknown or other
  misc_feature (782)..(782): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccgaggcctacccttgttctttcgtacctaccgaagggggaaacgaccgaccctacccgttctccgtggccgacgggacctaggtacgaggtagttaggttacgttcctactttcttacggtccttacggtaaccaaactaccaaaccgtcggaccgacggtccctcccggtaacgtccttaccccttattaacttttacgtacgggttactacggtaaccgtaaccgtaaccggaaacggggtaccggggtacccctaccgggttaccgggccccgttacccccggaacgggttaccggttaacgggttacccggtagggttaccgggtacggttaacggggtccggggttaccggttagggggaacctacggttaccttaccgtacctcgttaccaccgtataccgcgtacacgtaccgacggacgtacgttaggtaagttttattacgaacttttaacgtttcttacgtctacgtcgagttacgtacgtaacgtactacgttcccgaccgtccctagtaccttaccgaccgttacgaccggacggtactacgtacgaaggaataaaccggttaagacgttcggacgtacgtcgtaaccacttnttacncgtttntaccccg

SEQ ID NO: 69043 - DNA, 662 bp, Homo sapiens
  misc_feature: GYAE6OF01ESBEZ.51.76.G10.1.454.CMB.1.raw
  modified_base (198)..(198): a, c, t, g, unknown or other
  misc_feature (198)..(198): n is a, c, g, or t
  modified_base (458)..(458): a, c, t, g, unknown or other
  misc_feature (458)..(458): n is a, c, g, or t
  modified_base (599)..(599): a, c, t, g, unknown or other
  misc_feature (599)..(599): n is a, c, g, or t
  modified_base (632)..(632): a, c, t, g, unknown or other
  misc_feature (632)..(632): n is a, c, g, or t
  modified_base (643)..(643): a, c, t, g, unknown or other
  misc_feature (643)..(643): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagcccaccctgtctgtgtctccgagggaaanacgccaccctctccgtgcgacgggccagtcagagtgttagcagcgtacttacgccgttgaccagaccaacgaaacccgtggacccgacggtccctacccgaggtccctcccgtactaacgttctagtagactcgcctactaccgaaccggaacggcctaacgtgacttaccgccaagccgtaggttacgagggttcggacgtagggtcgggtacgtacgggaagtacgtacgttcaactttccaccacctataccgaccncggtaactccgttcggaagttacgttcgttaagtaagtttctttaggaacttttaaatttcgttacctggtacactaacgtaagtttacaagtttaccgtgttaccctcttacggtttccgtgggacccggagggtaaccncgggtactagggaacgtacgtaaacgtaaccgnggttaacggtntccgttacgaccctgtacg

SEQ ID NO: 69044 - DNA, 843 bp, Homo sapiens
  misc_feature: GYAE6OF01B2PJ4.51.76.G10.1.454.CMB.1.raw
  modified_base (203)..(203): a, c, t, g, unknown or other
  misc_feature (203)..(203): n is a, c, g, or t
  modified_base (818)..(818): a, c, t, g, unknown or other
  misc_feature (818)..(818): n is a, c, g, or t
tcagcgatcgtatacacgaccggtgctcgatttagtcactcatacagggggaggaactgctcagttaggacccagacggaaccatggaagccccagcgcagcttctcttcctcctgcttactctcggcctcccagactaccactggagaagtagtgatgacgcagtcctcacgccaccctgtctgtgtctaccgaaggggaancgccaccctcgtccgtgccgacggccagtcgagtagttcgttacgcgacggtccgtacttacggccgttacggtaccagaccgtaaacgtaaccgtcggaccgtacggtccctcccggaccggtccttccctactacgttcgtaacgtcggtacttcggacctaacgtaacccgaacggtaacccgggaccttaccgtagtaaccgttacctacccgtacgtacccggttacggttacggacgggttacgggacggttacggggttcggtacggtacgggaaccgttaggtaccggttaccacctttacccgactaacccgtagtacccggacgtaccgtaccgttacccggtctaacgggtcggttagtaaccgggtttaagttttaccgtttaacctaagttttttaaacgtttaccgtttaccggtacggtaaccttacggtaacgttaaacgtttaacttaaaccgggtaccgttccccggttacccgtttacccggtttacgtttaccgggttacccggggaccggtaaccggggtaacccttaaggggtaccgtacgggaaaccgtaacgtaaacccgggtaacgttaccgggttccgacggttaaccncccggttaacccgtacggtttaccc

SEQ ID NO: 69045 - DNA, 807 bp, Homo sapiens
  misc_feature: GYAE6OF01BSCXC.51.76.G10.1.454.CMB.1.raw
  modified_base (114)..(114): a, c, t, g, unknown or other
  misc_feature (114)..(114): n is a, c, g, or t
tcagcgatcgtatacacgaccggtgctcgatttagtcactcatacagggggaggaactgctcagttaggacccagacggaaccatggaagcccccagcgcagcttctccttccncctgctactctggctcccagactaccagtggagaagtagtgatgacgctagtcctccagcccacccgtgtctggtcgtctaccggaaggggaaacacgcccgaccctctcccgtgccgaacgggtcccaaggtcgtaagtaggttagttacgccaggtaccgaacgtttcgaccgtacggtaacccgaagaccgaacgtaaacccggtcggacccgtaggtaccccgtccgaccggtcctacccgtactacgttactacgtacgtagtacgtaccgtaccgtaacccgaacgggtaaccggtacctaacgtaacgtaacttaaacccgtacccggaccggtaaccggtagggttaacctacggggtggaacggttaaccggggttaggggttaccggtacgggtaaaccggtaccggtaccggttttacccgaacccggtttaccgtaccctaaaccgcggttacgaccggtaccgtaacgtccgtaaccgaacgttaggtaccgtaaggttacggttttaacttacggtaactttacttaacgttaacgtgttaacaacgttaacgtaacgttaacaacggttaccgtaccggtacccgttaacgttaccggttacgggtcgaaccgggacggtaaaccctggacgttaggaactaacgaacgaacgtcgtagccgaagacccgtatagtcc

SEQ ID NO: 69046 - DNA, 800 bp, Homo sapiens
  misc_feature: GYAE6OF01EVGM7.51.76.G10.1.454.CMB.1.raw
  modified_base (273)..(273): a, c, t, g, unknown or other
  misc_feature (273)..(273): n is a, c, g, or t
tcagcgatcgtatacacgaccggtgctcgatttagtcactcatacagggggaggaactgctcagttaggacccagacggaaccatggaagccccagcgcagtcttctcttcctcctgctactctggctcccagataccacgtggagaagtagtgatgacgcagtcctcagcccaccctgtctgtcgtcgtaccgaaggggaagacgcccacccgtctccgtgcgacggccagtcagtaggtgtacgcgagtccgtatacgccgtacggtaccngaaccaacggtaacccgtggaccgacggccgtacccgtacggccctccgtactagtctaacgtgtactccgactactacccgtaaccggaacggtccctactacgtaacctaccgtacccgacgaccggttacggtgtacgggtcggtacggtagggttccggggtagggtcgggtaacgtaagggtaccgtttaccgtaaccgttcccgacctaaccgtacgtaccgtacgtaccgacgtaccggtgtaccgtaacggttagtaacggtagttttaaccgtttaacgtaacgttttaacttttaccggtttgtacccggtagtaacgttcgtttaaaacggtaacgtttaaacggtacccgttacgggttaacccccttagtttaaccccggtttccggtttacccgggaaccgggttaaccggtaaaccggtaccggtagggttaacgggtaacccgtaacggtaaaccggtaaagtaaccggttggtaacccggtcggtaaacccggtccgtacgttaacccgg

SEQ ID NO: 69047 - DNA, 741 bp, Homo sapiens
  misc_feature: GYAE6OF01AT9UU.51.76.G10.1.454.CMB.1.raw
  modified_base (113)..(113): a, c, t, g, unknown or other
  misc_feature (113)..(113): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (314)..(314): a, c, t, g, unknown or other
  misc_feature (314)..(314): n is a, c, g, or t
  modified_base (502)..(502): a, c, t, g, unknown or other
  misc_feature (502)..(502): n is a, c, g, or t
  modified_base (705)..(705): a, c, t, g, unknown or other
  misc_feature (705)..(705): n is a, c, g, or t
tcagcgatcgtatacacgaccggtgctcgatttagtcactcatacagggggagaactgctcagttaggacccagaccggaaccagtggaagccccagcgcagcttctcttccncctgctacgtctggctcccagactaccacgtggagaagtagtgatgacgcagtctccagcccaccgtgtctagtcgtcctcgaaggggaaacncgcctaccctntaccgtgacacgggccagtcagagtgtagcagcgtacttagccgtagtacagcgaagtaacctggacctacgggtcctaccgaaggtcctaccgtanactcgtactcgtagtacgtacactaccgaacgaacggcctacgtacgactaccgtccagtacccgtaaggtcgaaggtcggtagtaggtacggtaacgaggtaaactcggtacttaccgaaccttccgtaacgaacctaagtcgaaccgacgtacgcccttggaaccgttagctttaaagaacgtttntttaacgaactttaaacgtttagtaacccgttggtaaaccctaggtaaaccctaaggtttaaaccgtaaacgttaacccggtccgtttaaccccgtttaaaccgttacgttaaaccgttaccggggaacccggttaaccgggaaaccttaacgggtacggtacgaaacgtaaccggttaaaccgaaaccgggtttccgggtanaccgggtaccttaaccggaacccgtaaacggttccc

SEQ ID NO: 69048 - DNA, 906 bp, Homo sapiens
  misc_feature: GYAE6OF01BSI5P.51.76.G10.1.454.CMB.1.raw
  modified_base (159)..(159): a, c, t, g, unknown or other
  misc_feature (159)..(159): n is a, c, g, or t
  modified_base (225)..(225): a, c, t, g, unknown or other
  misc_feature (225)..(225): n is a, c, g, or t
tcagcgatcgtatacacgaccggtgctcgatttagtcactcatacaggggaggaactgctcagttaggaccagacggaaccatggaagccccagcgcagtcttctccttcctcctgctactctggctcccagactaccacgtggagaagtgtgatgacncgtaggtctccgacgcccacccttgtctgtagtccgtcggaaggggaaagcgcccaccctctccgnggacgacgggcctaagtcagtagtgtagcgtacgcggttactacgccgtacggtaccagaccaacggtaacccgtggacccgtaggcccgttaccccgacggttcctaccgtactagttacctagtcgtaagtcaccgtactaccccggaacgtacgggacctactgtaacttaccgacccgtacgggtccgaaggttcgacgggtcggacgtgggttcgggtaccggtagggtactaacgggttctacgtaccgttacctacccttacgtaccgtggtaccgtacccggacgtaccgtacggcgttaacgtaccgtttaagggtaaccgttttagttttaacgtaaacgtttttaaccgttttacgttaaacggttaccgttaacgaaccggtttaaccgttaacggtttaaacggtttaaaccgttaccgggtttaaccggtttacccccgggtttacccggttttaaccccgggtttaacggggtttaccccggggtaaacccgggggtttaaaaccgggggacccgggtttaaaccggtacggggtttaaaacggggtaaacccggtttaccgttaaaaacccccgggttaaacgggttaacccggggttttaaaccggggtacccggggttaaccccgtaccgggggttaaaccctttaaccccgggtttaacccg

SEQ ID NO: 69049 - DNA, 822 bp, Homo sapiens
  misc_feature: GYAE6OF01AQO2H.51.76.G10.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtcgtctccgaggggaanacgccaccctcnccgtgcgacgggccaggtcagtgtgtagcngcgtacttgcctggaccagcaagaaccgtggaccgaggcctccgacggtcctccctacactctagtnatcnctacgtaccaacggtaacggcctacgtgaactcctaccgacgtaccggtacggtactaggtggcgtacgggttcgggtcggtagggacctaggtacgttcccgtacgttccacccgtactacgtcgacgtccgtacgtccgtacggtcgtacgtacgttaggttaacgtttacgttttacgtaaccgtttaacttttaacgtttaccgtttacgtaaccgtacggttaacgttaacggttttaaacgttaaaccgttttaacccgggttacccggttacccgttttaaccccgggtttaaccgtttacccgggtttttaacccggggtaccccggtaaaacccggggggtaaccctaaaacggggtttacccgggttaacggggttaaacggttaaacccgggtttaaacccgggtaaaaaccccggggttaacggggttttaccccgggttacccggggttaaacccggtttaaccccggaacccccggtttaaaccggttttaaccccggg

SEQ ID NO: 69050 - DNA, 807 bp, Homo sapiens
  misc_feature: GYAE6OF01AMME6.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagcccaccctgtctgtgtcctccgaaggggaaacgagcccaccctcctcctcggcgacgggccagtcgacgagtgttagcgagcgtacgttacgaccgttacggtacccgagacgaacggtaaaaccgtcgggcccgtaacgggtcctacccccgtaacgggcccttacccctactacttacgttaacgttacgaagttcgacctaccttacccaaaccggaaacggggaccctaagttacgaacttacctaccgtaacggaccgtacggttcgaacggttgggacgtagggtcgggttacggtagggacctaggtacgttaccacgtcctaccgacaacgtcgacacgcgtaccgtacgacgtacgttagtacgttaagttacgttttagaactttaaacgttttaacgtttacgttacgtacctaaggtaacttaagttaaacgttaaactaaccgttaccggttaccccttaacccggttttaaccgtttaccggtttaaccgggaacccgggttaaccgggggtaaaccctaacgggtaccgttacgggtaaaccgtaaacggttaaccgtaaaacccggttaacggttaacgggtacccggttagtaacccggtacccgttaacccgtttaacgg

SEQ ID NO: 69051 - DNA, 793 bp, Homo sapiens
  misc_feature: GYAE6OF01C491B.51.76.G10.1.454.CMB.1.raw
  modified_base (564)..(564): a, c, t, g, unknown or other
  misc_feature (564)..(564): n is a, c, g, or t
tcagcgatcgtatacacgaccggtgctcgatttagtcactcatacgagggggaggaactgctcagttaggacccagacggaaccagtggaacgccccagcgcagtcttctcttcctcgtgtctactcgtcggcctacccagtactaccacgtaggaagtaagttagtgacgtgaccgctacgtcctccgacgccctaccgtgttccgtgtcgtaccgacgggaaggggaacgtaccgccctacctcgtccgtacggacggacggtcctacggtacgaggttaggttacgtagacgtaacggttaccgtaaggttccgaccggttacgaaccgacggaccgaacggtaaccgccggaaccgccgtcccgaccggtcggtccctacctacgtacttacgtagtacgtacgactacccgtaacgaccggtaacgggaaacggtacctaacgtactaccgtaccgaccgtaacgtccggtacggtacgtacgggtacgggcgtttaggggtcgggttaggacggttaacgtacgttacgtactacttacgtacgtactacggtaccgngtacccgtgacctggtacttacggtaacgtaggtttacttaacgttataaacgttttctaacggtccttagtaacgtaacgttaaattaccgtacgtttaacctaacggttcccgttaaactttaccggtacggtacggtttaacgggaccgttaacgcgtacggttacgtaaggccgttaaacggtaacgttacgacgttcggaccgaaacttcgtacccgtattccg

SEQ ID NO: 69052 - DNA, 672 bp, Homo sapiens
  misc_feature: GYAE6OF01DENZD.51.76.G10.1.454.CMB.1.raw
  modified_base (151)..(151): a, c, t, g, unknown or other
  misc_feature (151)..(151): n is a, c, g, or t
  modified_base (164)..(164): a, c, t, g, unknown or other
  misc_feature (164)..(164): n is a, c, g, or t
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (382)..(382): a, c, t, g, unknown or other
  misc_feature (382)..(382): n is a, c, g, or t
  modified_base (506)..(506): a, c, t, g, unknown or other
  misc_feature (506)..(506): n is a, c, g, or t
  modified_base (580)..(580): a, c, t, g, unknown or other
  misc_feature (580)..(580): n is a, c, g, or t
  modified_base (604)..(604): a, c, t, g, unknown or other
  misc_feature (604)..(604): n is a, c, g, or t
tcagcgatcgtatacacgaccggtgctcgatttagtcactcatacgagggggaggaactgctcagttaggacccagacggaaccatggaagccccagcgcagtcttctcttcctctgctactctggctccagactacacgtggagaagtgngatgacgcagtcncagcctcctgtntgtcgtctcgagggaancgacctcctctccaggcagggccagtcaggtagtcgtagctgcgtaactgtccgtaggtacaacgcgaacgtaacgtcggaccgacgacctccgacgtctccactactactatacgtatgacactacaaccgaacggcctacgtacgccttaacgacccgagtcccgtaaggtttcgaggttcggaacngggttttcgggaccggtggaataccgtaggtacctacctagttaccaccgagtactacgacgacgtcagtacgtacgtgtaagtacgtttagttacctaatttaagtttcgtaactagttaacncgtaagtaaccgttaattaacccgtagttacccgtaccttacggttaccttaacgggttcccgttaaaccgggnggtaaaccctaggtaccgggttanaacgtaaccggtaaccgtaacggaaccgtttacggttacgaccggtctaaccccgaaacggtttcccg

SEQ ID NO: 69053 - DNA, 913 bp, Homo sapiens
  misc_feature: GYAE6OF01EG7SM.51.76.G10.1.454.CMB.1.raw
  modified_base (896)..(896): a, c, t, g, unknown or other
  misc_feature (896)..(896): n is a, c, g, or t
tcagcgatcgtatacacgaccggtgctcgatttagtcactcatacgagggggaggaactgctcagttaggacccagacggaaccatggaacgccccagcgcacgtcttcctccttcctccgtgcctactcgtcggcctcccagactaccacgtggaagtagtgtgatgacgctacgtcctccgacgtccctaccgttgtcgtacgtcgtaccgtacgggaaaggggtaacccgccctaccctcgtccgtggaccgacggggcctacgtacggaaggtacggttcgttaacgcgtaacggtaccgttacgtaccgccgttacggaaccagtaccgaaccggtaaccggcgaaccgtcggtccctaaccggtcgttaccctaccgttactaacttacgtacggtcgtaccggttccgaaccctaaccgtaaccggaaaccgggtaccgttacctacgttaagtaacccttaccccggaccggtaccggtaccggttaacggttaacggacgggttccggggacggtttaacggggtttccgggaacggggttaaacggcccgtttaaacgggtttacccttaacccgaccgtttaccccgaaacgtacccgtagtaacccgtacccgggtaaccgtacggttacccggtacgttacggttaaccggtttagtaaacggttttaacgttttactttaccggtaaattttaaacgtttcggtaaaccgttgtaaacgttacggttaaagttaaacgttaacctaaccgttaccgggttaccgtttacccgttaacgggtttaccgttaccggtaccgggaccggtaaaccggtaaccgtttaggggacttaacggaacgttaaccgggaaactttacggggttacggtcttacggtaccnccgtttaacgcgtttcc

SEQ ID NO: 69054 - DNA, 1046 bp, Homo sapiens
  misc_feature: GYAE6OF01EHUND.51.76.G10.1.454.CMB.1.raw
  modified_base (218)..(218): a, c, t, g, unknown or other
  misc_feature (218)..(218): n is a, c, g, or t
tcagcgatcgtatacacgaccggtgctcgatttagtcactcatacgagggggaggaactgctcagttaggacccagacggaaccatggaagccccagcgcagcttctcttcctcctgctactctcggcctcccagactaccacgtgggaagtaagtagtgatgacgcacgtctccacgccctacccgtgtctgttcgtccgtaccggaaggggaaacncgacccctaccctctccgtcgacggacgggcctaggtcgaaggtagttcggttacgcgtacggtaccgtacgttacgccgttacggtaaccaacggaccaaacggtaacccgtccgggacccgtaacgggtccctaccccggtacggtcccctttaccctaccgttaacctttacggtttacgttacggtaccgttacgaaacccgtaacccggttaaccccggaaaaccgggaaccccgggttaaccccttaaacgttaaccgggtaaaccctttaacccgtaaccccgggtaacccgggtaaccggtttaaaccgggttaccgtaaggggggtttaccggtaccggggtttacgggggttacgggggttaacgggttaacggggtaaccgtttaaacggggtccttttaaccccgacccgtttacccgtaaccctaaccgttaccgacgggtaacccgcccgggtacctccgggtagttaacccggtaaacggtttacggtaaacggttttaaacgttttcgttttttaaacgtaacccgttttttaaagtttttaacccgttaacggttttccgtaaaccggtaacgtttaaacgtttaaacgtttaaaacccgttaaacggttttaaccccgggttaccggtttaacccccggttttaaccgtttaaaccgggtttcccggggtttaaccgggaaccccggggttaaaaccggtaaccgttaaccgggggttaacggtaaggggtaaacccttaacccggggaaaacgtttaacccgggtacggttcgggttacgtaccctacgggttaccttaaccggttacg

SEQ ID NO: 69055 - DNA, 689 bp, Homo sapiens
  misc_feature: GYAE6OF01BGNVF.51.76.G10.1.454.CMB.1.raw
  modified_base (90)..(90): a, c, t, g, unknown or other
  misc_feature (90)..(90): n is a, c, g, or t
  modified_base (201)..(201): a, c, t, g, unknown or other
  misc_feature (201)..(201): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
tcagcgatcgtatacacgaccggtgctcgatttagtcactcatacgaggggaggaactgctcagttaggacccagacggaaccatggaanccccagcgcagcttctcttcctcctgctactctggcctcccagataccactggagaagtagtgactgacgcagtctccagcccaccctgtcctgtgtctccgaggggaaancgacccaccctctacctggccagggccagtcagagtagttacgcgagcgtaacgttacgacccgtggtaaccagaccaacggtaaaccctcggaccaacggcccttaccgaaggtccctccctaagtactacctagtagattcggacacgtaccgaacgaaccgggtaccagtcgtaaatacccgtcccgaagtccgtaagttccgaaggttcggacgtaacggtgggtacacgggaacagtaccgtttacaccgttcctacgaccctancgtacncgtacgtcctacgcgtacgtacgttaacggtaagtttactttacggtaacctttaagttttaacccttagttagtaacgtacgtaacgttaattaaacgtaaacgtacgttacgtacccttacgtaccgttacgtttccggaccggtaacggaccaaggtcgagggaagtaacgtaaacgtaaacgtacgtaggacgtagctaccgactacg

SEQ ID NO: 69056 - DNA, 765 bp, Homo sapiens
  misc_feature: GYAE6OF01AVJ84.51.76.G10.1.454.CMB.1.raw
  modified_base (211)..(211): a, c, t, g, unknown or other
  misc_feature (211)..(211): n is a, c, g, or t
  modified_base (758)..(758): a, c, t, g, unknown or other
  misc_feature (758)..(758): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggcctcccagactaccactggagaagtagtgatgacgcagtctaccacgcccacccttgtctgtgtccgtaccggaagggggaaacncgaccctaccctcctccgtggaccgacgggcctagtcgaaggtacgttgttacgccgaggtaccgtaccgttacgccgttacggaaccagtaccgaaacggtaacccgtcggacccgtaccggccctacccggacgtccctaccgtacctcttaacgtactagcgttccacctaccgtaacccgaaccggaacggtcctaacttacgacctaacccgtcccgaacgtaccggtaaggttaccgtaggtacgggacgtaggggtcgggtacggtacgggaactagggttacccgttacacccttccaacctacgactacgacgacctacgtcgtacgacgtacgttacgtaaggttaacttttcgtttaacgtaacttttaaacttcgtttaaacggttcgtaaaccgtagtaaccgttaaatttaaccggttaacctaccgttaccggttaccctttaacgttaccggtttgggaccggtacccggtaaccggtagagtacggtaagacgtaaacgtaccgtaaagacgtggtacctcggaacgttnccgttac

SEQ ID NO: 69057 - DNA, 711 bp, Homo sapiens
  misc_feature: GYAE6OF01B0CL7.51.76.G10.1.454.CMB.1.raw
  modified_base (304)..(304): a, c, t, g, unknown or other
  misc_feature (304)..(304): n is a, c, g, or t
  modified_base (436)..(436): a, c, t, g, unknown or other
  misc_feature (436)..(436): n is a, c, g, or t
  modified_base (492)..(492): a, c, t, g, unknown or other
  misc_feature (492)..(492): n is a, c, g, or t
tcagcgatcgtatacacgaccggtgctcgatttagtcactcatacaggggaggaactgctcagttaggacccagacggaaccatggaacgccccagcgcagcttctcttcctcctgctactctggcctcccagtataccactggaagaagtagtgagtgaccgcacgtcctccgacgccctaccctgtcctgtcgtctaccggaaggggaaagaccgccctaccccgtctacccgtgccgacgggccagttcgaagtaggttcgttacgacgacgtcgtaaccttacggcccgtacggttaccncggaacgaacggtaacctccgggccctaacggtaccctcccggacggtcccttccctacgtacttatacgtagtctacggtcctaactacccgaacggaccgggtcctacgtagtaacctaccctacccggngtaccgtaggtcgtacgcggtacggtaggtcgggtgtacggacgtataccggtacnccgtacctacaaccctgtacccgtgaccgtccgtcgttccacgttacgggttacctagggttaacttacggttttatacccttttaaaggttccttaacgtactgtactagtaaccttaagtaccgtacgtaccttccgtaactccgttacggtcgaccgggtacgagtacgagtacggactaagaccgtaagttaccgagtgacccgagtctctaccg

SEQ ID NO: 69058 - DNA, 648 bp, Homo sapiens
  misc_feature: GYAE6OF01EE4RY.51.76.G10.1.454.CMB.1.raw
  modified_base (627)..(627): a, c, t, g, unknown or other
  misc_feature (627)..(627): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctccagccaccctgtctgtgtctccgaggggaagcgcccaccctctcctgcgacgggccagtcagtagttgttacgcagcgtacttagccgtaggtaccagacaagtaaccgtggaccgacggcctacccgagtcctcctctacgtctagtcgagtcgactacgtaccgaacggaacgggtccctaagttacggtactaccgtacccgaacggtccgttaacggttcgaacgggtcggtacgtaggggttcgggttacggtagggaactacgggttacgtttacccacgtttcctaccgaacctagtacgacgccgacgtcctaggacctagttacgagttaatttcgtttagtactttaatttcgttacgtagtccaagtactaagttaactaacgttaccgtcgtacccttacgtacgttcgtacggacgtacggactacggcgtagaacgtacaccgtaanacgtgtcgacactactgtacg

SEQ ID NO: 69059 - DNA, 554 bp, Homo sapiens
  misc_feature: GYAE6OF01ED23U.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctccaggctcctcatctatgatgcatccacaagggccactgatactcccagccaggttcaggtggcaggtgggtctgggacagagttcacttctcaccatcagcagcctgcagtctagaatatttgactaatttattactgtacagtctaagtataataacgttcggtacccttaccgtaccttacgttttcggacccgtaacgggggtaaccctaaggtccgttagggaacgtacgtaaccgaaacgtaaccgttaggtcggaccttcggacctacccgttacg

SEQ ID NO: 69060 - DNA, 637 bp, Homo sapiens
  misc_feature: GYAE6OF01BQ6XG.51.76.G10.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (302)..(302): a, c, t, g, unknown or other
  misc_feature (302)..(302): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacggcagtctccagccctaccctgtcctgtgtctaccaaggggaaancgccacctcncctgccgagggcccagtcagagtgttagcagcacttagccgtgtaccagtcaagaacctggccaggctacccgaggctccgacatctatgntacgcactccaagaacggcctaacgtagtaacgtactacccgagaccgtaacggtctaaggtcggacgtacggtgggttcaggggacctagtacgttcgactttccgactaccgtatacgacgtacacgtccgtagactacggtacgtaagtaacgtagttttacacgtttaaattttaacgtacgttaccgtatacggtaagtaacgttaagtaaacgttaacgttcgaccgtttccgtaacttagtttaccgggaccgtaaaggtaaccgaacggtcgtaacggagtacctaacgaaccgttaacgtacggtagaccgtcgacctccgtaacg

SEQ ID NO: 69061 - DNA, 720 bp, Homo sapiens
  misc_feature: GYAE6OF01BK9VK.51.76.G10.1.454.CMB.1.raw
  modified_base (133)..(133): a, c, t, g, unknown or other
  misc_feature (133)..(133): n is a, c, g, or t
  modified_base (477)..(477): a, c, t, g, unknown or other
  misc_feature (477)..(477): n is a, c, g, or t
  modified_base (712)..(712): a, c, t, g, unknown or other
  misc_feature (712)..(712): n is a, c, g, or t
tcagcgatcgtatacacgaccggtgctcgatttagtcactcatacgagggggaggaactgctcagttaggacccagacggaaccatggaagccccagcgcagcttctcttcctctgctactctgcctcccganactaccacgtggaagaagtagtgatggacgcgtagtcctaccacgcccgtacctgtctgtcgtccgtacggagggaacaccgcccaccctcgtccgtgcgaccgggcctagtcgtaggtagtggtacgcgtacggacgtacgttcgccgtacggaccagaacctaacgaaccggtccggaccgtacggccgtacccgtcggtcccttacctacgttacgttcgtagtcgtacgtccgactaccgtaccgaacggaaccggtcctaggtacgtactacccgtaccgcgtaccggtacggtccgagggtcgtacggttgggtcggtcggaggtactggtacttccncctaacgctacacgtcgacgtcgaccgtcgtcgacgtacgttacgtaaggtttacgtttacgtttacgttacgtttaattcttcgtagttacgtacgtattaacttacgtaacgttaccgttaccgttaccttacgttacgttcggtacggaaccgtaccgggtaagaccggttagaccggtaattaaccggaccgttaaacggttcgtaccggttacgtaccctcgaacccgtnttacccgg

SEQ ID NO: 69062 - DNA, 832 bp, Homo sapiens
  misc_feature: GYAE6OF01BJ7OX.51.76.G10.1.454.CMB.1.raw
  modified_base (176)..(176): a, c, t, g, unknown or other
  misc_feature (176)..(176): n is a, c, g, or t
  modified_base (383)..(383): a, c, t, g, unknown or other
  misc_feature (383)..(383): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccacgtggagaagtagtgagtgaacgctacggtctccancccgacccttgtctagtcgtcgtaccgaaggggaaacgcgcccacccttcgccgtaggaccgaagggtacctaaggtacgaaggtagttggttaaacggcctaacggtacggttaaaccgttacgaccggttacggaaccgaacgaacgtaaaccgaaacgtcggaccgtacggacccgtaccggagtcctaccgtcattaccgtanacgactgactacgtaaccgacggaacgtacccagtactacctacgaaccgacgtacggtaacggtacgttagggacgtacggtacggtacgggtaccgtagggaaccgtaagggtcttaaccggactttccgaaacccgtacctaggtaacccgtaccgtaagtaacccggaccgttaacggacgttaaccggtacgttaaggttaaacgttacgttttaaccgacgttttaaaattttaccacgggtttaacgtaccgttaaggtagtttaaaccgttaacgtaaaggttaaccgccgggtttaaccccgttaacggtagtttaacccggtccgggtaaagaacccggggtaacttaaacggggacccgttagggaaaacgtacctaaaaaaccgggttacgtaaggtaaccgttaacggacggtaaacctcggtaaacccgttaacg

SEQ ID NO: 69063 - DNA, 755 bp, Homo sapiens
  misc_feature: GYAE6OF01BZ7R6.51.76.G10.1.454.CMB.1.raw
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
tcagcgatcgtatacacgaccggtgctcgatttagtcactcatacagggggaggaactgctcagttaggacccagacggaaccatggaacgcccagcgcagcttctcttcctcctgctactctggcctaccagactaccagtggagaagtgtgatgacgcagtctcgagcccacctgtctgtcgtccgtacggagggaacacgccctacctcgtcctggccgaacggcctagtacgagtacgtagtacgcgtacgacgttactcggtccgtacggacagaccgaagtaacccgnggaccgacggtacctcccggacgtcctcgtactaccgttntagtcgtactcgacacgtaccacgacggtctaacgtagactacgtcccgacgtcgtaggttaccgagggtcgtcggtaagggttccgggtagtaacggtaacggtcgttaaccgttacccgcttcgtaaccaccgtactacgtacgcgaccgtactacggtacgtacgtacgtaaggttaactttacgtttacgtaacttttaagtttactttacggtacgttacgtacgttaacgttaacgttaaagttaaccggttaccggtacgttaccgttaacggtttaccgttaaccggttaccgggtaaccggtaccggttacgtaaccggtacggtaagggtaacttaacccgggaaacccggttaaaggtacccggttacggttaacggtactttaaacccggtcgttaaaccgtttaccgg

SEQ ID NO: 69064 - DNA, 694 bp, Homo sapiens
  misc_feature: GYAE6OF01ASFNH.51.76.G10.1.454.CMB.1.raw
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccacgtggagaagtagtgatgacgctagtctccagcctcctgtctgtgcgtcgaagggaagcgccacctcgctgcgaggcngtnagtagtcgtagcacgcacgttacgccgtagtaccgacgctaacgtaacccgtggaccgtacggtccctccgacgtccctccgtactacctacgttaacgtacgtagtcgactaccgaccgtaaccggacgtccagtactacgtccgaccgacgtcggtagttcgaggtcgacgtacgggtggtaccgagggtaactaccgtcgtttaaccaccgttaccgtacccgtaaccgtcgttacggacggtaccgaccgttccggttacgaccgttaggttacgttaagttacgttaacgtttactaaactttaacgttttattccgtacgtacgttaacgttaataacgttaactaacgttcggtcccgttaccgttaacgttcggttaaccgttacggaaccggtaaccgtacgtaacgtcggtaagtaactacggtaaccgtaacgtaccggtcggagtcctacgaccgtcgttacg

SEQ ID NO: 69065 - DNA, 803 bp, Homo sapiens
  misc_feature: GYAE6OF01CWAKQ.51.76.G10.1.454.CMB.1.raw
  modified_base (209)..(209): a, c, t, g, unknown or other
  misc_feature (209)..(209): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggcctacccagactaccacgtggaagtaagtagtgatagacgcagtcctccgagcccacctgtctgtcgtctacggaaggggaanacgccctaccctctccgtgacgacggaccagtcgaaggtgttaggtacgcgtaggaccgtaacgttcgccgttaggaaccaggaacaaacggtaaacccgtcgggaaccctaccgggccctacccgacggtacctccgtacctagttaccgtaagtcggataccggacgaacctacccgaaacggaacgggtaccctaaacgtaacggactacccgtaacccgacgggttacccgtacggtttagacgggttgacggttacgggttcgggtacggacggggtaaacctaggttacgtttacccacttaccgaacctaacccgttagacccgacgtaccggtaactccggacgttacgtaagtttaccgtaaaggttaacgtttagttttaacgaacgttttaaatttacgttaatccgggttaacaaggtaccttaaagttaaacgtaaacgttccggtacccgttacccgttaacgttcgtttaaaccggttacgggaacccggaaaccgggtaccaggttcggaaacgggtaattaacaacccgggtaaagtacggtaccggtacgaccttaacggtaccgaacgtttaccg

SEQ ID NO: 69066 - DNA, 542 bp, Homo sapiens
  misc_feature: GYAE6OF01ATBUA.51.76.G10.1.454.CMB.1.raw
  modified_base (196)..(196): a, c, t, g, unknown or other
  misc_feature (196)..(196): n is a, c, g, or t
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
  modified_base (537)..(537): a, c, t, g, unknown or other
  misc_feature (537)..(537): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccaccctctcctgcagggccagtcagagtgttagctagcgattagcctggtacccagcaagaaacctggccagggcctcccaggcctcctcactctatcggatgacntaccacaagggccatcgatactcccaggcctaggttccaggtcggacaggtcggggtctcggggacagtacgttcaactctacacactcagtcacgctgcngtctagaacgtatttcgactatttacgttactgtacagctaagtataatacgtcgtaccttacgtacgtacttttaggccgtagggacctaaggtctagggatcgtacaacgtacgtcggtaggctggccnctacg

SEQ ID NO: 69067 - DNA, 826 bp, Homo sapiens
  misc_feature: GYAE6OF01EBTXW.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcgaggggaangcccaccctctcctgcacgggccagtcagagtgttagcagcgtacttacgccgtggtaccagacaacgaaacctcggccacggcctacccgaggtcctcctactacgtctagtcgtacgtcgtactacctacccgaaaccggaaccggggaccctaacgttacggtaaccttaccgttaccccgaacggtacccgtacgggtttccgaacgggttcggggtacggtacggggtttcggggttaccggttacgggggaaccgtacgggtaaccgtttacccgtaccctttacccgttaacctaaccccgtacgttacccggaacggtacccgtacggtccccgttacggtaccgttaacggttacgttaacgggttaacgttttacgttttacggttaaaccttttaagtttttaacgtttaacgtttcggtactaacggttaaccgttaagttaaacttaaacgttaaccgttccggttaccccgttaccgttaccggttaccggttttccggggaaccgggttaaccggggtaacccgtaacgggtaccggttaacgggtaacgtaaccgtaaacccgtaaacgggttaccggttcggttaacggtcgtaacgtacccttaacccgttacg

SEQ ID NO: 69068 - DNA, 718 bp, Homo sapiens
  misc_feature: GYAE6OF01B9PFU.51.76.G10.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccacgcctaccctggtctgtcgtctccggaagggaaacngccaccctctcctgcgagggccagtcagagtgtagcagctacgttcgccgtaggaccgacgacaacgaaccgtcggaccgacggcctcccgaggtcctccgtacntctatgacgtcgcacgtaccaacggtaacggcctacgtcgtaactacctacccggataccggtaggttacgagggtacggcgtagggttcggtacggtaggacgtagtcgttacctcgttacccgtacaacctacgtaccgacgtaccgtacgtaccgtggtaccgttacggtaacgtaggttaacgtttacgtttaacggtaaccttttaaatttagtttcgacgttaccgtaatcgttaaacgtacgttaaaacgttaccgtacccggttacctttacccgtaccgttttacggtttaccgggaccggttaaaccgggaaccgttaacggtaacgtagggtaaaccggtaaactaaccggtaaaccggttacgtacggttacgcgggtaactaacccgtgttaaccgg

SEQ ID NO: 69069 - DNA, 801 bp, Homo sapiens
  misc_feature: GYAE6OF01C1S5V.51.76.G10.1.454.CMB.1.raw
  modified_base (745)..(745): a, c, t, g, unknown or other
  misc_feature (745)..(745): n is a, c, g, or t
  modified_base (790)..(790): a, c, t, g, unknown or other
  misc_feature (790)..(790): n is a, c, g, or t
tcagcgatcgtatacacgaccggtgctcgatttagtcactcatacaggggaggaactgctcagttaggacccagacggaaccatggaagccccagcgcagcttctcttcctcctgcttactctggcctcccagactaccacgtggagaagtagtgatgacgctagtcctccacgcccaccctgtctgtcgtctccgaaggggaacacgcccaccctctcctagcgacgggccagtcagtagtgtagcaggacgtacttcgtccgtaggacacgacgaacgaaccgtcggaccgaacggcctacccggacgtccttacccgtactacttctagtcggactcgacctaccgttacccgaaacggaaccggtaccctacgtagtaaccgtacccgtacccgaacgtccgttacggttaccgaagggtcggacggttacggggttacgggtaccgggacgggtaactacgggttaccttaaccgtccgtttacccgaccgtacctaacgtaccggtaccgaaccttcccgggaccgttagtaaccggtaacggtttaacggtaaggttaaggttttttaaccttcggtaaaacttttaagttttccggttacgttaccggtaactagttaaaccctttaagtaaccgtttaaccgtccggttaccgtacccgtttaaaccgttcggtttaacccgggttaaccggggacccggtaaacggtaacgtacgggtccgtagggaaaaccttnaaaacccccgggttagtaccggtgggttaacccgccgtttaaccnccgttaactcg

SEQ ID NO: 69070 - DNA, 818 bp, Homo sapiens
  misc_feature: GYAE6OF01DWPF8.51.76.G10.1.454.CMB.1.raw
  modified_base (213)..(213): a, c, t, g, unknown or other
  misc_feature (213)..(213): n is a, c, g, or t
tcagcgatcgtatacacgaccggtgctcgatttagtcactcatacagggggaggaactgctcagttaggacccagacggaaccatggaacgccccagcgcagcttctcttcctcctgcctactctggcctcccagactaccacgtggagaagtagtgatgacgcagtcctccagccctacccgttgtctgtcgtcctaccggaaggggaaacnccgaccctaccctccttccgtggccgacggggccaaggtccgaaggtaggttagttacgctaggtccgtacgttacgccgtaggtaacccaggccgaaacgaaacccgtcggacccgtacgggccctacccggaggtcccctacccgttacgtaacttcttagttagaaccggttcaaccctacctacccgaaggaaaccggggtaccctacgtaacgtacttaaccgccccgtaacgtccggtacggttaccggtacggttcgggacggtaacggggtttcgggtaccgtagggaaccgtagtaccgttcctaccgttccaccctaccgtagtacccgagaccacgtccgtacgctacggtactaggttaacgtttatttcgaattttactttaacggttcttaccgggtacttaacgaattaacgttaaacgtttaacgtaaccgttcccggttaacccgtttaaccgtttaccgtttaacgggtttccccgggaagggaaaccccggtacgtaacggtaacggttaaggaacccggttaaataaaacccgggtaacccgttgggttacgggtcgtaaccgtacgtaccccgtcgtttacccg

SEQ ID NO: 69071 - DNA, 703 bp, Homo sapiens
  misc_feature: GYAE6OF01A95GA.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcgacgggccagtcagtagtgtagcagcgtacttcgcctggtaccagccaagaaacccgtggaccacggcctacccgaggtcctccgtcctagtcctaagtcgtaacgttcgacctactaccgaacggaaccgggcctaacgtagtaactaccgtcccaaggtccgtaacggtttcgaaggtcggtaccgtaggggtttcgggtacggtacggggaactaggttacgttccgaccttcctaacccgtaacctagtaccgaccgtacgaccggttcccagtacccgtagttacggtaagtaacgtttagttttacacgtttaaatttcgttacgtcgtactagacgttaagttaataacgttactcgggttaccccttacgttaccgttcggtttacggaccggtaacggtaaccgtaaggtaccgtagggaaacctaaccgttaaacgaaaccgttcggttaggtccggtaaccgtcgtaccgtccgttacg

SEQ ID NO: 69072 - DNA, 678 bp, Homo sapiens
  misc_feature: GYAE6OF01C83UB.51.76.G10.1.454.CMB.1.raw
  modified_base (146)..(146): a, c, t, g, unknown or other
  misc_feature (146)..(146): n is a, c, g, or t
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
  modified_base (326)..(326): a, c, t, g, unknown or other
  misc_feature (326)..(326): n is a, c, g, or t
  modified_base (391)..(391): a, c, t, g, unknown or other
  misc_feature (391)..(391): n is a, c, g, or t
  modified_base (441)..(441): a, c, t, g, unknown or other
  misc_feature (441)..(441): n is a, c, g, or t
tcagcgatcgtatacacgaccggtgctcgatttagtcactcatacaggggaggaactgctcagttaggacccagacggaaccatggaagccccagcgcagcttctcttcctcctgctacctctggcctccagactaccacgtgganaagtagtgatgacgcagtctccagcccacctgtctgtntctaccgagggggaaaancgtccaccctctccgtgacagggccctagtcaagcgttgttacgctaggcgtaactttacgcccttggtaacccagtaccaacgtaaacctgggacccaacgggccttaccccgaggccttccncgtaattccgtatcggattcgacctaacgtcccaacggtaacgggtcccacttacggacttaacncccgagtcctaggttacagttcggacgtagggtcgggttcgagggtaacnggggttacttccgaacttcctcgaaccgactaccgagtaccacgcctagcgtacgtcgttagtaagtatttcgtacttagtttacttacgtcgtactacggctacggtacgtaaaccgtcgtacggtccttccgttcgtttaccgggcggtaaccggaccggtaggtacggtaacggtataaccgtaaaccgttacgtacgtcggtacctaggtacctacccgtaagtccgttacgg

SEQ ID NO: 69073 - DNA, 758 bp, Homo sapiens
  misc_feature: GYAE6OF01BQ2SY.51.76.G10.1.454.CMB.1.raw
  modified_base (93)..(93): a, c, t, g, unknown or other
  misc_feature (93)..(93): n is a, c, g, or t
  modified_base (161)..(161): a, c, t, g, unknown or other
  misc_feature (161)..(161): n is a, c, g, or t
  modified_base (227)..(227): a, c, t, g, unknown or other
  misc_feature (227)..(227): n is a, c, g, or t
  modified_base (334)..(334): a, c, t, g, unknown or other
  misc_feature (334)..(334): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
  modified_base (467)..(467): a, c, t, g, unknown or other
  misc_feature (467)..(467): n is a, c, g, or t
tcagcgatcgtatacacgaccggtgctcgatttagtcactcatacgaggggggaggaactgctcagttaggacccagacggaaccatggaacnccccagcgcagcttctcttcctcctgctactctggcctacccagactaccacgtaggaagtaagtagngagtgaccgactagtcctccgacgccctacccttgtccttgtacgtccgtaccgggaaggggaacnccgtcccctacccttcgtccgcgacgtcgggacctaggacaggtacgtgtacgcgacggtcgtattccgacgtaggtaccagacgaacgaccgtcggacgacgtccnccgganccttacctacgtatctagtnacgtcacgtacaccgaggaccgcaacgtcactccacgagtaccgttancgacgtggtcgaggggttaccgngacgggtacacgttcctacaccgttccacgtaaccnctacgcggtactcgtaccgtagtaccgtacgttacggtaggtttaactttacggtttaacgttacttttaaacgtttacgtttccgttaagtaaccgtacggttaactaaacggtttaaacctaacgggtttaaccgtcccgttaaccggtttaaccgtttacctttacccggggttacggtaacccggggtacggttaaaccggtcgtaacgggtagtaaccgttaaaccggaccggtaaaaccggttcgttaaccggtcttaacccgggtctaacccgtcttaacccgg

SEQ ID NO: 69074 - DNA, 759 bp, Homo sapiens
  misc_feature: GYAE6OF01BVLGF.51.76.G10.1.454.CMB.1.raw
  modified_base (744)..(744): a, c, t, g, unknown or other
  misc_feature (744)..(744): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctcagccacctgtctgtgtctaccgaggggaacagcctaccctctccgtggccgagggaccagtcaggtaggttaggttacgcgaaggccgtacgttacgccgttaggtaccgagtacgaacgaaccgtcggaccgaacggccgtacccgacggtcctccgtacctacgttacttacgtacggtagtcctacgtacgtaacccgaacggtaaacgggtccctaccgttagaccttacctacccggacgtaccggtaacggtttccggtagggtacggtacggtacgggttacgggttaccggtaggggaaccgttacgggtaacgttcccgtaaccgttaccgttacccgaacctacgtaaccggaaccgtaccgtaccggtaccgtcgtaacgtacggttacgtaaggtttaacgttagttttcgtaacgtttagtttacgtttagttacggtacctagacgtaaccgaacgtaaccgtaccggttcgtaccgttacgggtaccgtccggttacggaccgtagggtaaccgtaagggtaaccgaacgtaacgtacggtacgtaggtccgtacgtcgtaaccncgtacgtcggtaccg

SEQ ID NO: 69075 - DNA, 786 bp, Homo sapiens
  misc_feature: GYAE6OF01AYBJC.51.76.G10.1.454.CMB.1.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcaggtctccagccaccctgtctgtgtctaccgaggggaanacgccaccctctcctgcaggggccagtcagtacgtgttagcagcgacttacgcctaggtaccagaccaagaacctggaccaggcctcccgaggcctcctcacgtntagtnagtcgcactaccgacgtaacgggcccaagtntaacgtactcccgaagtccgaacggttcaaggtcggacgtaggtcgggttcacggggactacggtcgttaccgacttccgtaccgtaacctacgttaccggacgtaccgacggttacccgtacggcccgtaacggttccttaagggtaaccgttaacgttttacggtaacctttaaacgggttttccttaacgttcgggttaaccgtaacggttaccgttaaacggttaaacgttaaaccgttaaccggttaccgggtaacccgtttaacccggttaaccgtttacccggttttaacggggcccgggttaaaaccggggtaacccgttaacgggtacggtttaaacggggtaaaccgttaaccgggtaaaccctaaaaccgggttaacccggtttacggggacccggttaacggtacccgttaacccggttaacccccggttaaagg

SEQ ID NO: 69076 - DNA, 804 bp, Homo sapiens
  misc_feature: GYAE6OF01ETZJD.51.76.G10.1.454.CMB.1.raw
  modified_base (380)..(380): a, c, t, g, unknown or other
  misc_feature (380)..(380): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcgagtctccagcccaccctgtctgtcgtctaccgaaggggtaaaacgacggcccctaccccgtccgttcctgccgaacggggacccaaggtaccaaggtaggttagtttaaggccgaacggtacgaactttaacggccgttacgggtaacccaaggaccgtaaacgtaaaaacccggtcgggacccgtacgggacccgttacccgaacggtccttacccctntaactaccttaagtagtcgtaaccggtctaaccgtacccaacggtaaaccggacctacgtacgaacttaccgaccctaacgccgtacgttacgaacggttcggacgtacggtgggtacggtacgggaacgtaaggtaacgtttacgaccgttaccaccgtaaccacgtacgaaccgtcggactaccgggtcaacgttacggtacgttaagtaacggtttactttaggtaactttaagttttaacgttaccctggttaacctaagtaacgaagttaaacaaacgttaccgggtacgtaccgttaaccgtaacgtttccgttaggggaaccgtacggggaaacttaccggtagttagggaccttaaaccgtaaccgtaaaacggacgttaagggtcggaacctacggtaccctaaagtttaaccgg

SEQ ID NO: 69077 - DNA, 732 bp, Homo sapiens
  misc_feature: GYAE6OF01DC4EZ.51.76.G10.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
  modified_base (719)..(719): a, c, t, g, unknown or other
  misc_feature (719)..(719): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccctaccctgtctgtctcgtccgagggggaaanacgcccaccctctcctgcagggccagtcagtagtgtagcagcctacttacgccgtaggtaccngacaaggaaccgtcggaccgacggtcctcccgaggtcctacctcgtaatcgtaatgagttcactaacncccgaaacggaaccgggaccctacgttacggtaacctaccgttaccccgaggtaccggtacggtttcgaacggtcggtaccgtaggggttacgggtcgtaggggaactagggtacgttaccgtactctaccactaacgtcgaacgtccgacgtaccgtacgacgtacgttacgtacggttaattacgtttttacggtaactttaaacgtttttaacgttacgttcggtactaacgacgttaaagttaaacttaaacggttacgttaccggtaccctttaccggttacgtttacgtttaccgggacccgttaaacgggggaacctacggtaccggtaggtaaacggtacgtaaacccgtaaaggtacggttacggtacggtacgtaacnccgtaccttacgg

SEQ ID NO: 69078 - DNA, 818 bp, Homo sapiens
  misc_feature: GYAE6OF01CHWJ3.51.76.G10.1.454.CMB.1.raw
  modified_base (209)..(209): a, c, t, g, unknown or other
  misc_feature (209)..(209): n is a, c, g, or t
  modified_base (264)..(264): a, c, t, g, unknown or other
  misc_feature (264)..(264): n is a, c, g, or t
tcagcgatcgtatacacgaccggtgctcgatttagtcactcatacagggggaggaactgctcagttaggaccagacggaccatggaagcccagcgcagcttctcttcctctgctactctggcctccagactaccacgtaggacgtaagtagtgagtgacgcagtcctccacgcccaccgtggtctgtcgtccgtaccggaaggggaaanccgccctacccgtctacctggcggacgggacctacggtcgaaggtagttggtaanccgagtcgttaccttcggccgttacggtaaccgacgacgaaaccggtaacccgtcgggaccgtacggtcccgtacccgaggtacccttcctatacgtccgtagtacgtacgtccgacctacgtaacccgaccgggaacggcccctagtacgtaactacccgtaccggacgtaccggttacggttacgtacggtacgggtaccggttagggtcgggtacggtacgggtaacgtaacggtttcgtaccgtccgtaccgtacctaacggtctacgaccgaccgtacgttccgacgttactacgtagttacggttaagtttcttttaaacgtactttaacgtttcttaacggtacgtacgttacgtaaagttacgtttaaactaacccggttagtaccccggttaccgttttaaccgttacctttaccggggttaacccgaacccgggtaggtaaaccccggtaacggttccggtaaagggttaaccaaacccgttaaaccgggttaaccgtacgtttaccgggtacggtacttaacccggaccttaccggtttaccg

SEQ ID NO: 69079 - DNA, 772 bp, Homo sapiens
  misc_feature: GYAE6OF01CI9I2.51.76.G10.1.454.CMB.1.raw
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (341)..(341): a, c, t, g, unknown or other
  misc_feature (341)..(341): n is a, c, g, or t
  modified_base (759)..(759): a, c, t, g, unknown or other
  misc_feature (759)..(759): n is a, c, g, or t
tcagcgatcgtatacacgaccggtgctcgatttagtcactcatacgagggggaggaactgctcagttaggacccagacggaaccatggaacgccccagcgcagcttctcttcctcctgctactctggcctccagactaccacgtggaagaagttgtgatgacgctagtcctccacgccctaccctgttctgtcgtcctaccggaaggggaaacncgccctaccctctccngcgacgggccagtcgagtagttgtacgcgtagccgtacttcgccgtaggtaccagacgaacggtaaccgtcggaccgacggtccctaccggagtcccttcctactacttanacgtgactcgacctaccgtacccgaaacggtacggacctacgtaacgtacgttacccacccggtaagtacccggttaggttacccgtagggtaccgggtacggttacggggtccgggttacggtaacggggaaactcggtttaaccgttactaaccttcccgacctaaccgtacgtacgaccgtaccgaacgttcgaacggtactaacggttagtaacggtttaacgtttacgttttcgtaaacttttaacgttttacgttacgttacgtacgtaggttaaacttaacgttaacttaaaccggtccgtttaccggttacccgtttaaccggttcgttaaccggttccggaaccggtaacgggtactagggtcaagggtactaacggtaacgaaaccgttcggttgggacctcgtaacncccgttattaccg

SEQ ID NO: 69080 - DNA, 703 bp, Homo sapiens
  misc_feature: GYAE6OF01AS1RX.51.76.G10.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtgtgatgacgcagtctccacgccaccctgtctgtgtcgtacgaggggaanacgccacctcctcctgcgacggccagtcgagngtgtagcagcgtactacgctaggtaccngacaacgtaaccgnggtaccacggccctccgacggccttcccctatactctaagtgtagtcgactacgtaccgaacgaccggaccacgtgtaacctactcccgacgtccggtagttccgaagggtcgacggtggttaccgggtggtacgggtaaccgtaggtaccgttttaccaccgttacccgtaccctaaccgtacgtcgtaaccgacggtaacctcccggtcgtaaccgttggttaacccggttagttaaacggttacgtttttaacgaactttttaatttacgtttacggttactacggtaagtaaccgtaacgtttacgtaacgttacggtccgtaccgttaccgtacgttccgtttacgggtacggtaacggaaccgtagtcggtagacgtaacgtacgtaaacgtcgtacggtcggaccgtacgtcccgtaacgttccg

SEQ ID NO: 69081 - DNA, 848 bp, Homo sapiens
  misc_feature: GYAE6OF01C6QQ1.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctaccgtgcgagggcccagtcagagtgtagcacgcgacttacgccgtggtaaccagactaaggaaaaccgtcggacccaagggcctacccgaggtcctccctctaagtcctaagtggaacttggccaatccccgaaagtaaaccggggcctaacgtacgtaactaacctccccgaacgtaccgtaacggtttacgaacggttcgggaccgtaacgggtttcggggtcctaagggggaactacgggttaacgtttccgtaaaccgttcccgtacctaaacctaacttaccgaacggaccgtacggccgttacgccgttaagttaccgtaggttaacggtttaacgtttttacgaaacttttaacggttttttaaacttaccgttaggttaaccgtacgtaaacgttaaacgtttaaacgttaaaacgttaaccggttaccggttaacccgttttaccggtttaacgtttaacccgggtttttaacccgggaaccccgggtaaaaacggggggttaacccccttaaaccgggtcgggtaaaggggttaaacgtaaaaccccgtttaaaaccggtaaaaaccgggttacgttccgggggttaacggttacccgttaaacgtaccccgttaaaccgtttaacccg

SEQ ID NO: 69082 - DNA, 690 bp, Homo sapiens
  misc_feature: GYAE6OF01DKA0Y.51.76.G10.1.454.CMB.1.raw
  modified_base (166)..(166): a, c, t, g, unknown or other
  misc_feature (166)..(166): n is a, c, g, or t
  modified_base (325)..(325): a, c, t, g, unknown or other
  misc_feature (325)..(325): n is a, c, g, or t
  modified_base (422)..(422): a, c, t, g, unknown or other
  misc_feature (422)..(422): n is a, c, g, or t
  modified_base (563)..(563): a, c, t, g, unknown or other
  misc_feature (563)..(563): n is a, c, g, or t
  modified_base (654)..(654): a, c, t, g, unknown or other
  misc_feature (654)..(654): n is a, c, g, or t
  modified_base (662)..(662): a, c, t, g, unknown or other
  misc_feature (662)..(662): n is a, c, g, or t
  modified_base (681)..(681): a, c, t, g, unknown or other
  misc_feature (681)..(681): n is a, c, g, or t
tcagcgatcgtatacacgaccggtgctcgatttagtcactcatacagggggaggaactgctcagttaggacccagacggaaccatggaagccccagcgcagcttctcttcctctgctactcgtcgcctccaagactaccacgtggaagtaagtagtagagtcgacnctagtacctaccacgcccctaccctgtctgtcgtctacggagggaacacgcccacctctcgcgtcgaggccaggtacaggtagttggtacgactacggctaaccgtttcggcctaggtaccagtaaccgaacgaaccgtacggcgaccgtccgtacccngtccctctacacttcgagtcgtactcacttacgaacccgagtaaccggctaacgtcgtaaccttaccaccctagtaccggtagttcgaggtacgggngttccgggtggttcggaacggttagtagtacgttacctaaccgtccgttaactaacggtaccgtagtacgaccggcgtaccgtcgtacgttacgttcgtagttaacgttcttttaacgttactttagtttacgttacgttntacgttataacttaagtaagttaacgttaccttcgtaccgttacgtaccgttacgttcgggaccgttaaaccgacgtacgtagatacgaanaaccgtanacggttcgacttagacccngtccgtacg

SEQ ID NO: 69083 - DNA, 824 bp, Homo sapiens
  misc_feature: GYAE6OF01C0NYS.51.76.G10.1.454.CMB.1.raw
  modified_base (205)..(205): a, c, t, g, unknown or other
  misc_feature (205)..(205): n is a, c, g, or t
  modified_base (277)..(277): a, c, t, g, unknown or other
  misc_feature (277)..(277): n is a, c, g, or t
tcagcgatcgtatacacgaccggtgctcgatttagtcactcatacagggggaggaactgctcagttaggacccagacggaaccatggaagccccagcgcagcttctcttcctcctgcctacttctggcctcccagactaccacgtggaagaagtagtgatgacgcagtctccagcccaccctgtctgtcgtccgtcgaggggaancgcccaccctctcctgacgacggccagtcagagttggtagacaggtccgacgtttggcccgttaggtaaccnggactaaacggaaacctccggacccgacggccttacccgacggtcccctaccgtacctagtccttaagtacggacttcgacctacgtaccccgaacgggtaacccgggtaccaaccgttagaccttaacccgcccgtagaccccggttaggtaccgaggtcgacggttagggtcggttacggacggtaacgtaggtacgttaccccagtttacccaacctaaccgtacgtaccgacgaccgtaccgtccgtacgtacgtaacgtaccgttaggttaagtttagtttacgtaactttaagtttttaccgttaacgttcgttacgtaagttaacgttaaactttaaacgtttaaaccgtaggtttacccggttacccgtttaacccggtttaccgtttaacccgggttttaacccgggaccgggttaaaccgggtaacccggttaaacggccggggtttaaaggaacgttaaaacccggtaaaaccggtaacgttaaacccgggttacggtacccggttccgtaaccgtacccgtacccgtttaaaccg

SEQ ID NO: 69084 - DNA, 722 bp, Homo sapiens
  misc_feature: GYAE6OF01CCXNX.51.76.G10.1.454.CMB.1.raw
  modified_base (630)..(630): a, c, t, g, unknown or other
  misc_feature (630)..(630): n is a, c, g, or t
  modified_base (716)..(716): a, c, t, g, unknown or other
  misc_feature (716)..(716): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccacctgtctagtcgtctccgaaggggaacacgcccacccgtctccgtgcgacgggcctagtcaggtagtgtacgcacgtccgacttacgcctaggtaccagacaacgtaaccgtggcccaggcctacccgacggtcctacccgtcaacttaccgtagtacggtataccggacctacctacccggaacgaaaccggggtccctaacgtacgtaacctaccgtaccccgacggtaccggttaacggtttaccgaacgggttgggaccgtaacgggtttgggtaccgtaacggggtaaccaaggggttaccctttaccggtaacccttcccgttaaccaacccggtactaaccggacggtaacctaacggtcccgtacgtaccgtcggttaacgaacgttagtttacgttaacgtactttaagtttacgttactagtacgtagtactaactataacgttacncgttccgtacttcgttacgttcgaccgtacggacgatcgtaggactagaaccggtaaatcggttacggttccgaagtacgtaccgnttaccg

SEQ ID NO: 69085 - DNA, 804 bp, Homo sapiens
  misc_feature: GYAE6OF01A6UPL.51.76.G10.1.454.CMB.1.raw
  modified_base (238)..(238): a, c, t, g, unknown or other
  misc_feature (238)..(238): n is a, c, g, or t
  modified_base (412)..(412): a, c, t, g, unknown or other
  misc_feature (412)..(412): n is a, c, g, or t
tcagcgatcgtatacacgaccggtgctcgatttagtcactcatacaggggaggaactgctcagttaggacccagacggaccatggaagccccagcgcagcttctcttcctctgctactctggctcccagataccacttggagaagtagtgaatgacgcagtctccagcccaccctgtctcgtgtctccgaggggaaatcgcccaccctctcctgcacgggccagtcagagttggttancagccgtattacgccgtggtaccagctaacgaaaccgtggccgacggcctcccgacggtcctacccttcatacttaagtgactcgtacactacccgaacgtaacgggaccctagtacgaactccttccgaacgtccggtaacggtttccagggttgacgtagggttcgggtcgnggggtaaccaggttaccggttaactccgttaccgtacctaacccgtacaccgtaacgcccgtaacgtccgttcggaacctttaggtaacccgtttaaagggttaacgttttacgtttttaacgaaaccgttttttaaatttttacccttaacggtttgtaaccgttaacgtaacgttaactttaaattaaaccgttaccggtttacggtacccctttaacccggttaaccgttttaacccgggttttcggggaaacccgggtttaaaccggggtaacccggtaacggtccgggttaggtaaaaccggttacggtttaaaaccccggtaaaaacccgggttgttaccgggttacggggcccttaaccgggttaaccctaacccggtttaacgg

SEQ ID NO: 69086 - DNA, 906 bp, Homo sapiens
  misc_feature: GYAE6OF01BH9LY.51.76.G10.1.454.CMB.1.raw
  modified_base (888)..(888): a, c, t, g, unknown or other
  misc_feature (888)..(888): n is a, c, g, or t
tcagcgatcgtatacacgaccggtgctcgatttagtcactcatacaggggaggaactgctcagttaggacccagacggaaccatggaacgccccagcgcagtcttctcttcctcctgctactctggcctcccagtactaccacgtggagaagtagtgatgaccgcagtctccagccctacctgtcctagtgtacctaccggaaggggaaactccgcccctaccctctcccgtaggaccgtaccggggcctacgtcgaaggtagttcgtacgacacggtccgtaacctttggccctttaggaacccgaggtaccgaacggtaaaacccgtggacccgtaacggcccgttaaccccggcggccctttacccctacgtaaccgttacctaaagttgacccgtacgtaccgtaaccctacccgaacggtaaccgggttacccacgtttacggaaaccttacccgtaccacgtccggtaacggtttcgacggtcggtacgacggggttcgggtccgacgggtactaaacgggtctttacccgaacgtttcccgaccgtaaccctacgttaaccgacggtaccgaaccggttcccgtacggtaacccggttaacgtcggtttaaacgggtaacttttccggtttaacggtaaccttttaaaaggtttttccgtaccggtagttaacccgtaaggttaactttaaacgttaacgtttaaacccggtaacccggtttaccgggttacccctttaaacccggtttacccggtttttaaccgggttaaccggggcccccggttaaaaacgggggtaccctaaggggtcccggttaacgaacggttaaaccccggttaaacgtaaaccgaccggttacggttaccgaccggtttaaccncccgtaacgttttaaccc

SEQ ID NO: 69087 - DNA, 705 bp, Homo sapiens
  misc_feature: GYAE6OF01EUW24.51.76.G10.1.454.CMB.1.raw
  modified_base (322)..(322): a, c, t, g, unknown or other
  misc_feature (322)..(322): n is a, c, g, or t
  modified_base (697)..(697): a, c, t, g, unknown or other
  misc_feature (697)..(697): n is a, c, g, or t
tcagcgatcgtatacacgaccggtgctcgatttagtcactcatacgagggggaggaactgctcagttacggacccagacggaaccatggaagccccagcgcagcttctcttcctctgcctactctggcctcccagactaccagtggagtaagtgtgatgacgctagtcctaccacgccctaccgttgtctgtcgtcgacggaaggggaacaccgccctaccctcgtaccgtggccggaacgggcctagtacgagttgtaggttacgcgtacggtacgtacgttaccgcggttacgacacgtacgaacgaccgtggccgtacnccgaccgcgtctaccgtatctacgtagtctacgttcgactaccgtaccgaacggtacggtacctacgtaacgtacctaacccgtccgaaccgttacggaccggttagtacggtccggaggttaccggtgggtaccacggtacgtagtcctacctcgtaccacaacgttcgactaccgtcgacgttccagttaccggacttagaacgtttatttcgtaacttagtttaaacctttgtacgtactagtaacttagtaacgtttaactaacggttacccgccgttaccggtttacgtaccgtttcggtaaccggaccggtaacggtaccagggtgtaaacggtacgtaactacgggaccttggacttcggaactccgnttcgtacg

SEQ ID NO: 69088 - DNA, 720 bp, Homo sapiens
  misc_feature: GYAE6OF01EJGY4.51.76.G10.1.454.CMB.1.raw
  modified_base (360)..(360): a, c, t, g, unknown or other
  misc_feature (360)..(360): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggctcccagataccactggagaagtagtgatgacgcagtctccagcctaccctgtctgtgtctccgaaggggtaagacgtcccaaccctcgttccgtgccgaaggggcccaggtcaaggtagttgttaacgccaaggcgtaactttacggccgtaggtaaccaggcgtaaggaaaccctcggacccaaggaccgttacccgaacgggtccctacccgttcctaactccttaaggtntaagtcgacacgtaccacggaaacgggtccacgttaggacttaacgtacccgacgaccgtaggttacaaggtcgggctacgggtgggttcgttagggacgtacgggtattccgtactcctaccacgtactacgacgcacgtaccgtagaccgtacgtcgtaaccgtaaggttacgttttacgacttttaaactttacgttaaacgtttcggtactaagtataacggttaaattaacgtaacgttccgtacccgttacgttaaccgttacgttttacggaccggtaacgggtaacccgacgtacggacggtataccgtaaaccgtaaacgtcgtacggtacgtctccggtctaacgttacg

SEQ ID NO: 69089 - DNA, 677 bp, Homo sapiens
  misc_feature: GYAE6OF01CUTKV.51.76.G10.1.454.CMB.1.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagtaagtagtgatgacgcagtctccagccctacctgtctgtgtcctacggaaggggaanccgccctaccctctccngcgacgggcctagtcaggtagtgtagcagcgtatacgcctaggtaccagacaacgaacgtggaccacggcctaccgagtcctcctactattacgtagtagactcgacctacctaccgaaaccggtaaccggacctacgtagtaactaccgtacccgaggtacccgttaaggtcgaacgggttcggacggttacgggtcgggtaacggtaggtaacctaggttaccgtacctacgtcctaaccacgtactacgacgaccgtacgccgtacgacgtacggttctaaggttaacgtttctttacgaacttttaactttcgtactagtacctaagtacgtaagttaactaacgtccgtacgtccttaccgtacgttaccggttacgaccgggtaaacgacgtaagtcggtagtaacgtaacaacgggtaactcggttccggatacctacgaccgttcgtac

SEQ ID NO: 69090 - DNA, 750 bp, Homo sapiens
  misc_feature: GYAE6OF01AT6WK.51.76.G10.1.454.CMB.1.raw
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (728)..(728): a, c, t, g, unknown or other
  misc_feature (728)..(728): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgctagtctccagccaccctgtctgtgtctccgaaggggaancgccacctctcctgcgacggcagtcagagtgtancgagcgtacttacgccgtacggaccagactaacgaaccgtggaccgacggccttacccgacgggtccttcccgtacctattccgtaatcggtaacgtcgaacctaccgttacccgaaacggtaaccgggacctacggtaactactacccgtaacccgacgtccgtaacggtttcgaagggtcgggtacgtaggggttgggtcggtaacgggtactaacgggtactttcccacgttacctaccgaccttacgtcgaacgcgtaccgtaccgtacgacggttacgtacggtttaacgtaacgtttagtttaacgtactttaaagttttacttacgtttactaagtaacggttacttaaagtttaacgttaaaccttaccgggtttcctacccggttttaacccgttaacgttccgggtttaccggaaccggtaacgggacccgtaaggtacgtacggtaacgtaccgtaacccgtaaacggttaccgtgggttaaccngtttaccaccgttacttaccgg

SEQ ID NO: 69091 - DNA, 818 bp, Homo sapiens
  misc_feature: GYAE6OF01BURHR.51.76.G10.1.454.CMB.1.raw
  modified_base (461)..(461): a, c, t, g, unknown or other
  misc_feature (461)..(461): n is a, c, g, or t
tcagcgatcgtatacacgaccggtgctcgatttagtcactcatacagggggaggaactgctcagttaggacccagacggaaccatggaacgccccagcgcagcttctcttcctcctgtctactctggcctacccagactaccactggagtaagtagtgagtcgacgtcagtcctaccgacgccctaccgttgttccgttgtcgttccgtacggaaggggtaaacctcgaccccctaacccgttccgtaccgtcggaccggacgggttacccaagtacggtaaggtacggttcggttaacgaccgtaacggtacgttaacgttaccgtaccggtacggtaaccaacggtaccgtaaacgtaacccggtcgaccggaccgtacctaccggacgttccctacctactacttacgtagtcgtacgctacgtacctaccaaccggaccgtacctacgacgttaacncccgtaccaggtaccgtaggtcgaccggttggacgtttacgggtcggcggtaacggtacgtacggtacttccggacctaccggtaacacgttcaccgtagtacccgactccggttagacgtacgtttaacgaatttaacggtttacttaacgtagttttaaacctttgtacgtcgtaacctaagttactaacggttaactaacggttacgttacccgtaacgtttaccggttacgtttaaccgggtaccggtaacgggtacccggaccgtacgggttagaaccgggtttaacacgggttaaacccgtaccggtacggtttacgacccggttccgtaaacggtcccttagggttaccc

SEQ ID NO: 69092 - DNA, 742 bp, Homo sapiens
  misc_feature: GYAE6OF01CNSDV.51.76.G10.1.454.CMB.1.raw
  modified_base (211)..(211): a, c, t, g, unknown or other
  misc_feature (211)..(211): n is a, c, g, or t
  modified_base (506)..(506): a, c, t, g, unknown or other
  misc_feature (506)..(506): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccacgtggagaagtagtgatgacgcgagtcctaccacgaccctaccctgtctgtcgtcctacggaaggggaaacncgcccaccctctcctgaccgaggcctagtcgaggtgttagtacgcgacgcggtacttcggccgtaggtaccacgacgtaaacgaaccgtggcccgaacggtccctaccgacggtccctccgtactacttacgtagtcgaccttgacccacgtaccccggaaacggaccgggaccctaacgtcgtaacctaccccgtacccgacgtaccgttaacggttccgaacggtcgggacgtagggtccgggtacgtagggtaactggtaaccgttccgaacccgtccttaaccgaccgtanaccgaacgtccgtaacgtcgtacgtacgtagtacgtagtacgtttagtttactaactttaacgtttactacgtacgtacgtataacgtaacttaagtaaccgttacgtcccgttaccttaaccggtccttaaccgggttaccggaccggtacgggaaacccgtacggttcggaacggtaactaaccgtacggaaaccgttacggtcggtacgaccttacccggcttaaccggttcg

SEQ ID NO: 69093 - DNA, 906 bp, Homo sapiens
  misc_feature: GYAE6OF01BVTKD.51.76.G10.1.454.CMB.1.raw
  modified_base (155)..(155): a, c, t, g, unknown or other
  misc_feature (155)..(155): n is a, c, g, or t
  modified_base (162)..(162): a, c, t, g, unknown or other
  misc_feature (162)..(162): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacgaggggggaggaactgctcagttacggacccaggaccggaaccatggaacgccccagcgcagcttcctcttcctctgcctactcgtggcctcccagactaccagtggganaagtagngagtgacgcagtcctccagtccctacctgtcttggtcgtcctacgggaagggggaacacctcccctaccctccgtacgtcggaccgacgggtccaggtcgaagtaggttacggtacgcgaacggtcctaacggtttccgaccgttacgtaccgacgtaccgaaacgtaacccggtacggaccgaacccggtccctaccggaccggtccctccgtttanaaccctttgtaagtacgtcgtaccgttaccaaccggttaaccgaaccggtaacccgggtacttaccggtacgtaaaccttccccggtaacccgtcgtaaccggttcggttacggacgggtacgggtacggttacggggtacgggtaccggtacggggtaccttaacgggtaccgtttaccggccttacccgtaacccgttagacgtacccggacgtaccgtccggtacgttaacccggtacgtacgggtttaccttaagggttttaacgttaagtttttaaccggttaactttttaaccctttaacggttaacgttccggtaaccgttaaccgttaattaaccgttaaacgttaaccgtaccggttaacccggttaaccccttttaacgggtacccgtttacgggttaccgggtaaccgggtaaccggttaaaccgggtagtaacccgtaagggttaacgaacccggttaaaaccgaacgggtttaggaccgggtttaccaggttaaccctacgaccgttttacgg

SEQ ID NO: 69094 - DNA, 920 bp, Homo sapiens
  misc_feature: GYAE6OF01B3KAT.51.76.G10.1.454.CMB.1.raw
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
tcagcgatcgtatacacgaccggtgctcgatttagtcactcatacgaggggggaggaactgctcagttacggacccagacggaaccatggaacgccccagcgcagccttctcttcctcctgctactctggcctcccagactacccacgtggagaaggtagtgatgacgcagtcctccacnccctaccctgtctgtcgtcctccgaaggggaaancgccctaccctctcctgcgaggccagtcagtagttagtacgctagacgtacttcgccgtacggtaccagaccgaacgtaaccgtccggaccgacggtccctaccggacggtcccttcccgtacctacttcgtaacgtcgtactacgaccgtaacctacccggaacggtaaacccgggcccttaaccgtaccgttaacttaacccgtacccgaacggtacccgggttaacgttaccggtagggtcggtacgggtacgggtttacggggtccggtacggggaaacgtacggtttaccgtttacccgtacccgttacccgtaacccttaaccgtaacccgttaccggaccggtacccggtaccgtacccggttaccgtaccggtttaaccggttaaccggttttaacggtaaccggtttttaagttttaacccggtttaaaccgttttaaacgtttttaacccgtttaacgtttacggtttaaaccgttaacgttaaaccgttaagttttaaaaccttaaccggttaccgttacccggtttacccctacccggttttaaccggttacccggtttacccgggttaaccgggaacccgggtttaaccggaaccggtttaacgggtaggttaaaaccggtaaccgttaaaccccggtaaacggttaccggttacgggttaaccgaccggttacccgtaaccgtcccgttacg

SEQ ID NO: 69095 - DNA, 694 bp, Homo sapiens
  misc_feature: GYAE6OF01CT8MS.51.76.G10.1.454.CMB.1.raw
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
  modified_base (574)..(574): a, c, t, g, unknown or other
  misc_feature (574)..(574): n is a, c, g, or t
  modified_base (684)..(684): a, c, t, g, unknown or other
  misc_feature (684)..(684): n is a, c, g, or t
tcagcgatcgtatacacgaccggtgctcgatttagtcactcatacagggggaggaactgctcagttaggacccagacggaaccatggaagcccagcgcagcttctcttcctcctgctactctggcctccagactaccacgtggaagtaagtagtgatgaccgctagtcctccacgcccacccgtgtctcgtcgtctaccggaaggggaacncgcccaccctctaccgngcgacggccagtcagtagtctagcacgcgtacttgccgtacggtacacgcgtaacgaacctcgggaccgacggccctacccggaggttccctaccgtactacttaccggtatcggtactaccgaccaccgttacccggaaacggaaccggtccctaacggtcgtaacctacccgtacccgacggttaccgtaggttaccgacgggttgggacgtacggggttcggttacggaggggttaaccacggttccgttaacctccttacaacctcctacgacgacgaccgtacgtctacggtctacgttacgagttacgttagtttactaacttatttacgtactctacgnttaacagttaactaacgtacaccgttacctcgtacttcgtacccggtaacggaccggtactacggcgttacggaataccgtaacgtaacgacgttacgggacttcgaacncgtactacgg

SEQ ID NO: 69096 - DNA, 676 bp, Homo sapiens
  misc_feature: GYAE6OF01A5GP4.51.76.G10.1.454.CMB.1.raw
  modified_base (211)..(211): a, c, t, g, unknown or other
  misc_feature (211)..(211): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaacagccaccctctccngcagggccagtcagagtgttagcagcgacttagcctggtaccagaccagtaaacctggaccaggctaccaggctcctgatacgtatcgatgacataccactaaagggccattagaatctacccgagccgtaaggttaccgagttcggggactagtggggtctacggggaactaaggcggtttaccaacgttaccgtacccaaaccgtacgtaccgtaacggaccgtaacgggtcccttaacggtacgtaacggttaccgttaaggtaaacgttaacggtttttacggaccttaaacgtttttaactttacgttacgttacgtaacgtacgtaaccgttaagttaactaaacgttcgtaccgttacgtacctacgtttacggaccgtacgggaactaacggtacgtagggaacgtaacgtacgtaaacgtaaacgtacgtacgggtacctcggacctaccggtaac

SEQ ID NO: 69097 - DNA, 859 bp, Homo sapiens
  misc_feature: GYAE6OF01EPIEO.51.76.G10.1.454.CMB.1.raw
  modified_base (159)..(159): a, c, t, g, unknown or other
  misc_feature (159)..(159): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagagtagtgatgacgnacgtctccagcccaccctgtctgtgtctaccggaggggaaagacgcccaccctctccgtgacgacgggacctacgtcaaggtagtggttacgacgaggccgtaacgttacgccgttagggtaaccacgggactaaacggaaacccgttacgggacccgaacggtaccctaccccggtacggtcccctttacccgtactaactttaccgttaagtagtaacgttccggacctaacttaaccccgaaccggaaaccggggtacctaccgttaggaaaccttaccgtacccccgtaagggaccctttaagggtccgtaacgggttccggggaaggttacgggggttttacggggtaccggtaacggggaactttagggtacccgtttaccgaaccctttcgtaccccaacgtaactaccgaacgtccgtaacccgtccgtacgaacgtacggttagttaaggttaacgtttacgtttaacgtacgttttaactttaacgtttaacgttcgtacgtaacgttaacgtaaaggtttaaactaaccgttaacggttacccgtacccgtttaaccggtttaacccgtttacgggtttaacccggaccggggtaaacgggtaacccgtaaggaccggtaagggaacggtaacgaaaccgttaaacggtaccgttcgggtaccgtaagccggtacccgtaacgttaccg

SEQ ID NO: 69098 - DNA, 914 bp, Homo sapiens
  misc_feature: GYAE6OF01CRIWK.51.76.G10.1.454.CMB.1.raw
tcagcgatcgtatacacgaccggtgctcgatttagtcactcatacaggggaggaactgctcagttacggacccagacggaaccatggaagccccagcgcagcttctcttcctcctgctactcgtcggcctccagtactaccacgtggaagaagtagtgagtgacgctagtcctaccacgccctacccttgtcttggttcgtaccgtaccgggaagggggaaacaccgtcccctaccctccgtccgtcgaccggacgggacctagtcgaaggttagttacgtacgcgtaacggtccgtaacgttacgtaccgtacggtaccgtacgaccgtaaaccggtaaccgtccggacccgacgtacccgtaccgaccggtccttacccgtactacgtacgttagtacgtacgtactacctaaccgtacccggaacggtaccggaccgtacgtaacgtaccttacccggtacccgtacggtacccgtagttaccggtacggtcggtacggtacggttcgggtacggtaacggtaacgtacggttaccgttacccaccttacctaaccggtccttacgtaacccgtaccgtacgtacccggtcgttaccgtcgtaacggttacgtaaggttttaacgtttacgttttaccggtttaaactttaacgttttactttaaccgtgttaaccggtaacgtttaaccttaaagtttaacgtaacccggttttaccggttaccgttaaccccggtttaacgtttaacccggtttacccgggtttaccggggaaaaccccggttaaccggggtaacccgttaacgttaaccgggtaaccggttaaaccggtaaccggttaaaacccgaacgggtttacggttaccggtaaccggttacccgtaacccttaaccgtacccggtttaaccgg

SEQ ID NO: 69099 - DNA, 804 bp, Homo sapiens
  misc_feature: GYAE6OF01DGX0F.51.76.G10.1.454.CMB.1.raw
  modified_base (91)..(91): a, c, t, g, unknown or other
  misc_feature (91)..(91): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
tcagcgatcgtatacacgaccggtgctcgatttagtcactcatacagggggaggaactgctcagttaggacccagacggaaccatggaacnccccagcgcagcttctccttcctctgctactcgtggcctccagactaccacgtgggagaaggtagtgatggacgcagttccaccagccctaccgtgtctggtacgtccgacggaaggggaacnccgccctaccgtcnccgtgccgtacgggaccaggtacaaggtgttaggtacgcgacggacgtacgttacgccgtacggtaaccgagaccgtaacgaaccgcggaccgacggccctacccgaggtcccctaccgtactaacctcgttaacgtagacgtacgacccgtactaccgaaccggtaaccggtacctacgttacgaacttaccgacccaaggtccgtaacgggttaccgagggtccggaacggttgggttcgggttacggacggtaacgtacgggttaccttaccgtaccgtcctacccgtaactacgtaccggtaacgccggtaacgtcccgtacgtacgtaacgtacgttaggttaacgtttagtttacgtaaacttttaagtttaacgtttacgttaacgacgtttaacgttaacgtaaagggttaaccttaaacggtacccgttaccgggttacccttaccggttacgttacccggttacgggaccggtaaacgggacgtaaacgggtcgtacgggtaaactaaccgtaacggttaaaccgtacggttacgggtacgtaccgacgttaaccctacggtaccg

SEQ ID NO: 69100 - DNA, 923 bp, Homo sapiens
  misc_feature: GYAE6OF01A2V48.51.76.G10.1.454.CMB.1.raw
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgcagtctccacgccacctgtcctgtntctaccgagggaanacgccacctctccgtgcgacggccagtaccaggtaggtgttagactacgtacgtacttacgccgtaggaccagactaacgtaaccgtcggaccgtaacggccctacccgaggtccctaccgtactacgttaccgtatcggtactacgaccctacgtaaccgaaccggtaacccgggtactacgtaacgtacttacccgtacccggtaacgtccgtaaagggtttccggacggttacgggtcggacggggtttacgggttaccggtaggggtaaccgtacggttaccgggtttaaccacctttacccgtacccgtaacgggtttaccaaccggtaacgaccgttacccggccgtttaaccgggacgttaccggttaactaacgggtttaagtttaacccgtttttacggtaaaacttttttaaccgttttaacggttacggtttaaccggttactaaccggtttaacgttaaaggtttaaaccctttaaacgggtttaacccggttaccccggtaaaccgggtttttacccccggttaaagtttttaaccccggggtaaccggggttaaacccccgggtaaaccgggttaccgggttaaaccggttacggggttaaacccggtaccggttaaaaccccgtttaaacgggaaacccccggtttagggttaccccccggggttagaaccccggttaacccggttacccctaaccggttttaaccggg

SEQ ID NO: 69101 - DNA, 787 bp, Homo sapiens
  misc_feature: GYAE6OF01BOWKN.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgcagtactccagcccacctgtctgtcgtctcgagggaancgccacctctctgcgcggctgtacagtagtgttacgcgacgtcgtacttacgcgttacggtaccacgacgtaacgaaaccgtcggaccgtacggccgtcccgggccttaccgtctaacttcgtaagtcgtacgtcggcctaacgtaccaaacggtacgggtacctacgtacgtaacttaccgtacccgacgtccgtaacggttcaacgggtcggtacgtacgggttgggtacggtagggtacgtacggtaccgtttaccgaaccgttcctaaacccgtcctacgtaacgtacggactaccggtccgtacggtacgtaacggttacgtacggttaatttacgtttacgttaaaccgtttaagttttacgttaccggttacgtaccttaacggtaacgttacgtttaaacgttaacccgttaaccgggttacccgtttaccgttaacccgttacgtttacccgggttaaccgggtaaccgggtaacccgggtaacgtaccgggtacggtaaacggggtattaaacggttaacccgtaaacgtgggtttacgtaccgttacggtacctaaacgtccccgttaggtttccccg

SEQ ID NO: 69102 - DNA, 704 bp, Homo sapiens
  misc_feature: GYAE6OF01C4I55.51.76.G10.1.454.CMB.1.raw
  modified_base (153)..(153): a, c, t, g, unknown or other
  misc_feature (153)..(153): n is a, c, g, or t
  modified_base (268)..(268): a, c, t, g, unknown or other
  misc_feature (268)..(268): n is a, c, g, or t
  modified_base (305)..(305): a, c, t, g, unknown or other
  misc_feature (305)..(305): n is a, c, g, or t
  modified_base (429)..(429): a, c, t, g, unknown or other
  misc_feature (429)..(429): n is a, c, g, or t
  modified_base (456)..(456): a, c, t, g, unknown or other
  misc_feature (456)..(456): n is a, c, g, or t
tcagcgatcgtatacacgaccggtgctcgatttagtcactcatacagggggaggaactgctcagttaggacccagacggaaccatggaagccccagcgcagcttctcttccctcctgcctactctggctcccagataccactggagaagtagngatgacgcagtctccagtcccaccctgtctgtacgtctccggaaggggaaataccgcccaccctctcctgcgagggcctagtcaggtagtgtagcagacgacttcgccgtgaccngacacgaaccgtcgaccgacggcctccgagcctcctntacttagtatggactcgaacctacgtaccgaacggtaccggcctaacgtacgaacctaccggtaccacggtaccgtaggtaccgagtcgggcgttgggtcgggtcgagggacctagtacctacnctactcccaacgactaccgcgaccgtntccggtgtaccagttaaggtaacgttacggttatttcggttaaattaacttttagttaccgactgaaacgttgaaactttaaacgttaccgttacgtacccggtaccttttaaccccggtatttcccgggtttacggaacccgggtaccggggtaaacctacggttacgggaagttaaaccggtcgttaaaaccgggtaacgtaacggttacgggtaacgtccgttaacccgggtactcccgtttacg

SEQ ID NO: 69103 - DNA, 955 bp, Homo sapiens
  misc_feature: GYAE6OF01EAN8X.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggaanacgcccaccctctccgtgcgacgggccagtcgagtagtgttaacgcagacgtacttacggccgttaggtaaccacggaccgaacggtaaacccgtcggacccgacggtcctaccccgaagggtcccttcccgtacctacttaccgttaacgtcggtaacgttcgtacctaaccgtacccggaacgtaaccggggtccctaaacgttacggtaaccgttaccgtaccccgacggtacccggttacggttaccgagggttcggaccggttacgggttcggggtacgttacggggtaaccgtacgggtacgttttacccgaaccgttcccgtaaccctaaccgtacgttaccgaaccggtccgtaccggtacccgttacggtaccgttaacgggttacgttaaacgggttaacggttttaccggtttttaacggtaaaccgtttttaaacgttttttaaccgtttaccgttacggtttaaccgtaacggttaaccgtttaaaacggtttaacgttaaaaccggtttaaccccgggtttacccggttacccccgttttaaacccgggtttaaccggtttttaccccggggttttaaccggggaaaccccggggttaaaccggggggtaaaccccttaaggggttacccgggtttaaagggtaaccggttaaacccgttaaaacccgggtaaaacccggttaaaccgggtttaccggttaacccgggttaaccgttaccggtaaccccgtaaccccgtttaacgg

SEQ ID NO: 69104 - DNA, 775 bp, Homo sapiens
  misc_feature: GYAE6OF01B7QG6.51.76.G10.1.454.CMB.1.raw
  modified_base (153)..(153): a, c, t, g, unknown or other
  misc_feature (153)..(153): n is a, c, g, or t
  modified_base (219)..(219): a, c, t, g, unknown or other
  misc_feature (219)..(219): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
tcagcgatcgtatacacgaccggtgctcgatttagtcactcatacagggggaggaactgctcagttaggacccagacggaaccatggaagccccagcgcagcttctcttcctctgctactctggcctacccagactaccactggagaagtagngatgaccgcgagtcctaccgacgccctacccgtggtcctggtcgttccgaccggaagggggaaacncgacccctacccttcgtaccgcggcgacggggcccaaggtctaggtaggtgtacgccgacggtacgactttagggcccttggtaaccgagactaacggaaccgtcggccgtaccggcctacccgaggtcctacctacacgttactagnttaacngacctacgaccaacgaacgggacctacggtacaactcgtaccccgagtaccgtaacggtcaagggtcgggtacgtaaggggttccggggaccgtaaggggtaacgtaaacggttcggttaccgtaaccgtaccgttacccaaccggtactacgtaacgaccggtacggtacccgtcggacctagggttaaccgttaaggtaacgtttacgtttaattaaccgtttaagttacgtttacgtagtacgtacggtaacctaaggttaacttaacgtaaccgttacccggtaccctttaacgtaaccgttaccggtacggtaaccggtacgggtaacgtaacgggtacgaggtaactacggtaaccgtaaacggtacgtcgttacggctaacgggtctacgtacgg

SEQ ID NO: 69105 - DNA, 739 bp, Homo sapiens
  misc_feature: GYAE6OF01A32ZI.51.76.G10.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (393)..(393): a, c, t, g, unknown or other
  misc_feature (393)..(393): n is a, c, g, or t
tcagcgatcgtatacacgaccggtgctcgatttagtcactcatacagggggaggaactgctcagttaggacccagacggaaccatggaacgccccagcgcagtcttctcttcctcctgcctactctggcctcccagactaccacgtggaagaagtagtgatcgacgctagtcctcacgccctaccgtgtcctgtgtacctacggaagggaacncgccctacctcgtaccgnggcgtacgggcctaggtacgagtaggttagtacgacgtacggtaccgtacgtacggtccgtacggtaccagacgaaacgtaaccgcggaccgcggtacccacgcgaccttccactagtcctagtcgtacgtccgactacaccgaaggtaccggcctaaggtntaacctaccgtaccgacgttaccggtaggtacgaggtccgggtacgtacggggtcgggttaacggtacggacgtacgttacggtacctacccttacgtacacctaacgcgtaacgccgtacgtcgttaaccgcgttacgttaacgtaagttacgttttagttacttaacttttagtttaaccgtgtaacctagttacgttaagtaacttaacgttaccgtacccgttcggtaccctttacgtaccggttcgttaccgggaccggttaacggaacgttcgaacggtagttaacgtaaccggtaacgttaacggtcgtaagttcccgaagttacgacgttaccgttcg

SEQ ID NO: 69106 - DNA, 878 bp, Homo sapiens
  misc_feature: GYAE6OF01AFYT8.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggcctcccagataccactggagaagtagtgatgacgcagtctccagccctaccctgtctgtgtcctccgaggggaanacgcccaccctctccgtgcgacgggccagtcagagtgtacgcagcgtacttcgccgtggtaccagcgaacgaaccggtcggacccgacggtccctaccccgacggtcccttcccgtactacgttaccgtagtacgacgtcgacctaaccgtacccgaacggaccgggacctaacgtcgtaacctaccgtacccgacgtaccgttacgggttaccgagggttacgggacgttacgggggtttcgggtacggtacggggaaactacgggttaaccgtttacccgtaccgttaccctacccgtaacccgtacgtaccgaaccggtccgtaccggtccgttaacggtacccgtttacggttaacggttaacgggtttaagtttaacgtttttaaccggaaacgtttttaaacgttttaccgtttacccggtttacggttaaccgtaacggtaaccggttaaacgtttaaaccgtttaaaccggttacccgtttacccggttaaccccgtttaccgtttaaccgggtttaccgggtttaaccgggaacccgggttaaacccgggacccgtaaacgggttaccgggttaacgggtaaccgttaacccggtaaaccggttaaaccggttaaccggttccgggttaaccggtacccgttaccgtaacccgtaacccgtttacggg

SEQ ID NO: 69107 - DNA, 693 bp, Homo sapiens
  misc_feature: GYAE6OF01EZI8K.51.76.G10.1.454.CMB.1.raw
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (437)..(437): a, c, t, g, unknown or other
  misc_feature (437)..(437): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccacctgtctgtgtctccgaggggaaagcgaccctaccctcctaccgtgccgacgggcctacgtcagtagtcggttacgcacggaccgacgttacgccgttacggaccagacaacggtaaaccgtcggaccgacgggtcctcccgacggtcctcctacnctactntgatcgcacctccgaacggaacggtccagtacgtaactccaccacgccgtaacggttacgaggtcggcgtagggttggtacgtcgggtacgaggtacgttaacncttacgtctaccacttcgacgcacggcttcacgtactacgtagtacgttttagttgttaaacttacggttttaattacgtacccgtagtactacgttaaagtacgtaaacgtttaccgtacgtacccgttacgtttaccggttaccggttttaccggaacggtaaaccggggtaaccgacggtacgtaacggtaacgtaacgtaacgggaaaaccgttacggtaccggtacgtaccgtaccggtcccacggttacc

SEQ ID NO: 69108 - DNA, 952 bp, Homo sapiens
  misc_feature: GYAE6OF01E2Q42.51.76.G10.1.454.CMB.1.raw
tcagcgatcgtatacacgaccggtgctcgatttagtcactcatacaggggaggaactgctcagttaggaccagacgaaccatggaagccccagcgcagcttctcttcctcctgctactctgctccagactaccactggagtaagtagtgatgacgctagtcctaccgacgcccacccttgtcttgttcgtaccgtaccggaagggggaaacgccgaccctaccccttccgtccgtagaccggacgggcctaggtaccgtaggtagttcggtttacgacgacggtaccgtacgtttaccgccgttacggtaaccgacgtaccgaacgtaaaccggtcggaccgacggtcctacccgtacggtccttacctacctaacttaccttacggtcgttacgtccgactaccgttaacccgaacgggtaacccggacctaacgtacgttacctaccgtacccggtaccgtaccggttaacggttacggtacggtcgggtaccgggttacggggtttacgggttaccgggtacgggttaacgtaacggggttaaccgtttaccctacctttacccgtacccgtaacccgttaccgacggtaacccgttaccgaaccgttacccggttacggtacccgttacgtttaacggtaaaccggttttaacgtttaccggtttttaacgtttaactttttaaaccgtttttaccgtttaaccggtttacgttaaccggttacttaaacgggttttaaactttaaactttaaacccgggttaccttttacccggggtaaccctttaccgggtttacccgtttttaacggggtacccgggtaaccgggttaaacgggtaaaccggttaaccgtacccgggttaagggtaaacccgtaacccggttaaccggtaaacgggttcgttacccgggttccggtaacggttaccgttaaccgtcggtttaccc

SEQ ID NO: 69109 - DNA, 723 bp, Homo sapiens
  misc_feature: GYAE6OF01D51EA.51.76.G10.1.454.CMB.1.raw
  modified_base (243)..(243): a, c, t, g, unknown or other
  misc_feature (243)..(243): n is a, c, g, or t
  modified_base (537)..(537): a, c, t, g, unknown or other
  misc_feature (537)..(537): n is a, c, g, or t
  modified_base (708)..(708): a, c, t, g, unknown or other
  misc_feature (708)..(708): n is a, c, g, or t
tcagcgatcgtatacacgaccggtgctcgatttagtcactcatacagggggtaggaactgctacagttaggacccagaccggaaccaatggaacgccccagcgcagcttctcttcctcctgctactcgtggcctcccagtacttaccgacgtggaagaagtacgtgatgacgctacgtcctaccagaccctacccttgtccgtgttcgtccgtaccggaagggggaaacacgccctacccctntccggtgacggacggccgtaggtacaaggtagttggtacgcgtacggtaccgacgtttaccgccgttacggaaccgtcgaacgaaccggtaaccgcggtaccgacgtaccgcccgtaggtccctccgtaactcgtactacgtgtacgtcgaactacgtacccgaaacggtaccggtactaactcggtaacctaccctaacgacgtaaccgtaggttcgaacggtcggacggtgggtacgggttacaacgggtaactacggttacgttacctaccggttaccaacctaaccgtanacgtacgacgtacgcggtacacgtacgtattacggtacttagttaacgtatttaacgttgtagtctacggtatactaagttaacgtaactcggttactccgttaacttgggtaaccttcgaaccgtaccgatcgtaacgtaagtcgtaaagaacctacggtatcggtactntaccggactccgtac

SEQ ID NO: 69110 - DNA, 779 bp, Homo sapiens
  misc_feature: GYAE6OF01DVT0M.51.76.G10.1.454.CMB.1.raw
  modified_base (162)..(162): a, c, t, g, unknown or other
  misc_feature (162)..(162): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (590)..(590): a, c, t, g, unknown or other
  misc_feature (590)..(590): n is a, c, g, or t
  modified_base (761)..(761): a, c, t, g, unknown or other
  misc_feature (761)..(761): n is a, c, g, or t
tcagcgatcgtatacacgaccggtgctcgatttagtcactcatacagggggaggaacctggctcagttaggacccagacggaaccatggaagccccagcgacagcttctcttcctcctgcctactctggcctaccagactaccactggagagtgtgatgacncagtctcagccacctgtctgtacgtctaccgaaggggaaacgtcnccctaccctcnccgtacggacacggggccctaggttccaaggtacggttgtaacgcctaagggtccgaacgttttaggccccttaggggtaaccaggtaccgaacggtaaacccgttcgggacccgttacgggtcctacccgtacgggtccttccccgtactacgttacgttatacgacgttcggacctacgtacccgaacgttaaccgggccttacgtacgtacttaaccgcccgaaggtccgttaggttacgtaacgggtcgtaccggagggttcgggttcgaacggggacctaaggtaccgttacgaccgttacctaaccgtactaacgaccgttaacgccgtaacggtccctaggactaaccgtgtacggttaacgttnttttaggtaactttacgtttatcccttggtactacggtactaagtacccttaaacgtccggttaccgtaccctttagtaccccgttttagggttaccgaccgggttaaccggttaacgaggttaaccggttacaacggttaaccacggtaaccgacggtttcgaaaccgtnttcgaacctcgttaaacg

SEQ ID NO: 69111 - DNA, 783 bp, Homo sapiens
  misc_feature: GYAE6OF01DG4I8.51.76.G10.1.454.CMB.1.raw
  modified_base (240)..(240): a, c, t, g, unknown or other
  misc_feature (240)..(240): n is a, c, g, or t
  modified_base (647)..(647): a, c, t, g, unknown or other
  misc_feature (647)..(647): n is a, c, g, or t
  modified_base (774)..(774): a, c, t, g, unknown or other
  misc_feature (774)..(774): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccgactggaagaagttagtgaactggacgtcacgttcctaccaggaccctacccgtgtctgtcgtacaccggaaggggaaataccgcccaaccgtcttacccgnggaccgacggggtccctaagtacgaaggtacgtttaggtaacggctaaacggtccgtaaaccgtttacggcccgtttacggggaaacccaacggtacgaaaccggtaaaacccggttcgggaaccctacggcccgttacccgaacgggtcctcccctagtacttacctaagtacggtatacgacaaccgtaccaacggacggaccaacgttacgattaccaacccgtaggacccgttaggttacggaacgggttacggacgttacggggtccgggttacggtaacgggaacgtaacgggtacgtttacaccttacgaccgtaactacgacgtacgcgtaccgtacgacgtacgtaacgtcgttaagtacgttaagtttactaacgtttaactttaacgtacgtttanaacgtacgtaacgttaaacgtaacttaacgtacccgtacgtccgtaacgttacgttacgtttaccggacgtaccggacgtaacgtaccgaaggtactaacgagtaacgtaacgtcgtacgacgtacnctacgtacg

SEQ ID NO: 69112 - DNA, 580 bp, Homo sapiens
  misc_feature: GYAE6OF01EGT4D.51.76.G10.1.454.CMB.1.raw
  modified_base (197)..(197): a, c, t, g, unknown or other
  misc_feature (197)..(197): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcaggggccagtcagagtgttagcagcgacttagcctggtaccagcagaacctggccaggctcccaggcctcctcatctatgatgcatccacgacgggccatgatactcccagccaggttcagtgcaggtgggctggacngagttcactctacaccatcacgcacgcctgcgtagtcctagtaagttgttttacgacttaaattttacttacgtacgtacgtaacgtctaagttaataacgttaaccgttcggttacccttaccggttactttaaccgttttcgggacccggtaacggggtaacctaagggtccgttagggaactacgtaacgaaacggtacgtggtacggactcgacctaccgtacg

SEQ ID NO: 69113 - DNA, 822 bp, Homo sapiens
  misc_feature: GYAE6OF01AXJHG.51.76.G10.1.454.CMB.1.raw
  modified_base (214)..(214): a, c, t, g, unknown or other
  misc_feature (214)..(214): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggacgtaacgtagtcgacttcgaccgcacgtcctccacgcccacccgtgtctgtcgtcctccgaggggaaacncgccacctctcctgcgacgggccagtcagtacgtgttacgcagcgtacgttacgccgttggtactacgacgacgaacgaaccgtcggaccacggtccctacccgacggtcctcctactacgttacgtacgtacgactcgacctaccgtaccgaacggaaccgggtacctaaccgtacgtaaccttaccgtaacccgacggtaccgtacggttacgtagggttcggacggtagggtacgggtacgtacgggaacctaggttaccgttacctaccgtacctaccgtaacctaactaccgtacgtaccgaacgttccgtacggtacgttaacggtttacgttaaggttaacggttttacgttttacgtaaactttaacgtttttaacgtttaacgtttacgtaacttaacggttaaccgttaaacggtttaaacgttaaacggtttaaccgttaccggtttaaccccgttacccgtttaaccggttaccggtttaccggaaacccgggtaaacgggtaacccggttaacggtacgggttacggaaacgttaaccgtaaacccggtaaacggttaaccggttacggttacggtacgtaccgtacccgtaacg

SEQ ID NO: 69114 - DNA, 708 bp, Homo sapiens
  misc_feature: GYAE6OF01DD9XX.51.76.G10.1.454.CMB.1.raw
  modified_base (172)..(172): a, c, t, g, unknown or other
  misc_feature (172)..(172): n is a, c, g, or t
tcagcgatcgtatacacgaccggtgctcgatttagtcactcatacgagggggaggaactgctcagttacggaccaggacggaaccatggaacgcccagcgcagcttctcttcctctgctactctcggctccagactaccacgtggagaagtagtgatgacgtcagtcctacngcctaccctgtctgtcgtctccgaagggaacacgcctaccctctcctgaccgacgggcctagtcgaagtcggtgttacgccgaggtcgtaacgtcgtccgtaggtaaccagaacgaacgtaaaccgtgggacctaacggcccttccgaccggtaccttcctaccgtatttacctaagtcggtaactacggacctaaccttaccgaaacggtccgggtacctacgacgtactaccgtaccgacgtacgtacggttacgaggtccggtagtcggtggtacggtagaacgtacgtaacttccaacgttcctacgtactaacgtaccaggtaccgtcgtacctgtacctaggttactagtaactttgttacgtaatttaacgttttacgtactcgtacagtacgtaattagtaacctcgtaccgtccctttaacgtacgttccggttaccgggaacgtaccggtacgtacggtagtaccggtaaattacccgaaaacgttaacggacgttaggtcccggtataaccgcggttacttccgg

SEQ ID NO: 69115 - DNA, 863 bp, Homo sapiens
  misc_feature: GYAE6OF01B877F.51.76.G10.1.454.CMB.1.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
tcagcgatcgtatacacgaccggtgctcgatttagtcactcatacgagggggaggaactgctcagttaggacccagacgaacatggaagccccagcgcagcttctcttcctcctgctactctggctccagactaccacgtggaagaagtagtgatggacgcagtctccagccctacccgtgtctgtgtaccgtccggaaggggaaacncgaccctacctcgtccnggcgacgggtacctagtaccgaggtaagttcgtaagccgacgtacggaacctttacggaccgttacggtaacccgaggacctaacgggaaaaccgtccgggtaacccgcgggtaccccttacccgacggtcccttacccttacgtaacgttaccttaacggtaggaacttcgaccttaaccgtaccggaacggtaaaccggccctacggtactacctacccgtaaccgcggttaaccgtaacggtttcccgacggggttacggaggtttacggggtaccgggggtacgtaccgggggaaactttaaaggaccggtttctaacccgccgttacaaccgtaccgacgtaacgccgtacgtccgtacgacgttaacgtaccgttaaaggttaactttaacgtttagtaaacctttaaagttttacctttagtaacgttaccgtaacgtacgtaaaacgttaacgttaaaaccgttaccgttacccggtttaaccttaacccccgttaggttaacccggtttacgggaaaccgtaaccgggggtaactacccgggtaggaaaggtaaccgtaaaacggttaaccggtaaaaccggttagggttacggttaacggaccctaccgtaacggttaccgtttaacg

SEQ ID NO: 69116 - DNA, 772 bp, Homo sapiens
  misc_feature: GYAE6OF01DRUK7.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctccagataccactggagaagtagtgatgacgcagtctccagccacctgtctgtgtactacgaaggggaaaccgccaccctctccgtgccgagggcctagtcagtacgttagtagccaagcgtacgttagccgtaggtaccagcgaacgaaaccgtggaccaggcctacccgagcctcctcgtactcgtatcgtaagtcgctactaccgaacaacgggacctacgtagtaactactaccccaagtccgtaacggttcctaagggttcccggaggtacggttacgggtcgtacggggacgtaacgggtacgttaccgtaccttccgttaccgaacccgtacgttaccgtaaacggccgtaacggttaccccgtacggtaccgtaaccggttaccggttaaggtaaacggtttaacgtttttaccggtaaactttaaacgttttttaacgtttacgtttaggttaacccgtaaggttaacgttaaacggttaaatttaaaaccggttacgttaaccgggttacccctttaacccggttaacgttaccggttttacgggaacccggtacggggtaaaccctaagggtccgtaagggtaactaccgtaacgtaaacggttacgtacgggtacgtgtaccgtataccgttacg

SEQ ID NO: 69117 - DNA, 869 bp, Homo sapiens
  misc_feature: GYAE6OF01ACSWW.51.76.G10.1.454.CMB.1.raw
tcagcgatcgtatacacgaccggtgctcgatttagtcactcatacgaggggggaggaactgctcagttaggacccagacggaaccatggaacgccccagcgcagcttctcttcctctgctactctggcctacccagactaccacgtagggaagtaagtaggtcgatcggaacgcgtagtcctaccacgccctacccgtgtcctggtcgtcctaccgggaaggggaaactccgcccctacccgttctccgtcggacgaacgggcctagtcgaggttacgtgtacgcacgtcgtaacttcgccgtacggtaccacgacgaacggaaccgtggaccgtacggtcctacccggtacggtcccttacccgtatacttaccgttaagtcgtaacggtactaccgtaaccgtaccggaaaccggtaaccgggtccttaaccgtaggtaaccctaccggacccggtacgggtaccgtaacgggtttcggaccgggtaggggtccggtaaggggttcggggtacgtagggaacgttcggttaccgttacacccttacgtccgtaacgtaccgtacgacccggttagtcccggtaccgtacggtaaccgttagggtaacgttaacggtttaacgttaccggttttaagtaacttttaacgtttaccgttacgggttaacttaaccggttaagaccgtttaaacggttaacttaaccgggttacccgttaccggtttacccgttaccggtttaaccggtttacccgggttacgaccgggggtaaaccgtaaccgttacgggacgggttaacgtaaacggttacccgtaaacgtaaacggttcgggtcccgttaaggtcccaaccgtccgtaaccgttccg

SEQ ID NO: 69118 - DNA, 840 bp, Homo sapiens
  misc_feature: GYAE6OF01BTB39.51.76.G10.1.454.CMB.1.raw
tcagcgatcgtatacacgaccggtgctcgatttagtcactcatacaggggggtagggaactggctccagttaggacccgagaccggaaccattggaagccccagcgcagcttctcttcctcctgctactctggctcccaggtataccactggagaaggtagtcgatgacgctaagtctccacgcctacctgtcctgtgtccgtcggaggggaaacgcgggcccaccctcgtccgtggccgagggccagtcaggtacgttgttacgctacggccgaaccgtttaggacccgttgggtaacccgtaggaccaacggtaaaccgtcgggacccgtaacgggcctacccgacggtcccttaccggcgtacgtaccgtagtcggtacgtacgtaactaacgtaccgaacgggaacgggaccccgtaacgtacggtaacttaaccgtacccgacggtaccccgtaagggtttaccgacgggttacggaccgttaaggggtccgggtaccgtacgggtactaggtaacggtttaccaccgttactaccgaactagtaccgacgtccaacggtctgtaccgagtaccgttagggaactttacgttaacggtaccttaaagttttgtaactttacggacgttaacgtaccgttaagttacgttaaaaccgttccgttaaccggtccctttaaccggtaacccgttaccggtttcgggaaccggttaacccggggtaacctaaacggtcgggtaaccgggttaacgtaccggttaacccgggaaaaacggtttcccggggtaaacgttacccgggggtacggttttacccaacccgtcccccggttaaag

SEQ ID NO: 69119 - DNA, 926 bp, Homo sapiens
  misc_feature: GYAE6OF01DU024.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgcctactctggcctcccagactaccacgtggaagaagtagtgatgacgcagtctaccagccctacctgtctgtcgtcctaccggaaggggaaacacgccccaccctcgtccgtagaccgagggcccaggtacgaagtaggttagttacgcgtaacggtccgtaacctttacggcccgttagggtaacccaggaacccgtaaacggtaaaacccgttcgggacccgtaacgggtccccttacccgtaacgggtcccttaccccggttaactaaccgtttaccgtttaagtacggtaacttccgtaccgtaacccgttacccgaaaccgggaaccggttacccctaaccgttacggtaaaccctttaccccggacccgtaacggtacccggttaacggtttacgaaacgggttcgtaacgggggggttacttacgggtaccgtaacgggaacgttaggtaccgttacaaccgttaccgtaacctacccgtatacccgacggtaccgaacgtcccgtaaggtactaacgggttacctaaggttaacgtttacggttttaacgaaacctttttaaacgttttaaccgttccgtaacggttaactaacggttaacgttaaccgttaaacgtttaaacccggtacccggttaccggttaaccctttacccgttaaccgttttaccgggttaccgggtaacccggtaaacccgggtaacctaaggggtacccgtagggtaaacccgttaaaccgtaaaccgggtaaaccgttaacgttacggtaacgtacccgttacccggaacctacggtttaaccg

SEQ ID NO: 69120 - DNA, 971 bp, Homo sapiens
  misc_feature: GYAE6OF01ASDTX.51.76.G10.1.454.CMB.1.raw
  modified_base (126)..(126): a, c, t, g, unknown or other
  misc_feature (126)..(126): n is a, c, g, or t
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (204)..(204): a, c, t, g, unknown or other
  misc_feature (204)..(204): n is a, c, g, or t
  modified_base (211)..(211): a, c, t, g, unknown or other
  misc_feature (211)..(211): n is a, c, g, or t
  modified_base (236)..(236): a, c, t, g, unknown or other
  misc_feature (236)..(236): n is a, c, g, or t
  modified_base (250)..(250): a, c, t, g, unknown or other
  misc_feature (250)..(250): n is a, c, g, or t
tcagcgatcgtatacacgaccggtgctcgatttagtcactcatacaggggaggaactgctcagttacggacccagacggaaccagtggaacgccccgagcgcagcttctcttccgtctgctactcnggctaccagactaccagtcggagagtgtgatgacncagtctccacgccnccgttgtctgtacgtcaccgaggggaacnccgtccncctcgtctgacgacgggctaacgtnagttagtcggtaancacgtcgtaacttcggtcgtacgtaccgtagtacaacgtaaccgtcgccgtacggacctccgacggtccttacctacgtacgttaccgttagtacggtacgtaccgtacctacgtacccgtaacgaaccgggtcctaagttacggtaaccttaccgacccggtacgtaccggtacggttaaccggacggtaccggttcgggaccgggtttacgggtcccgttaacgggtaccgttacgggtaaaccgttttaccggaacccgttacgttaaccgtaaccgttacgtaaccgtaaccgtcgtaccgtaacccgttcggtaacggttacggttaacccggtaaaggttaacgttttacggtttaacggtaaacctttttacgggtttaaccttaacccgggttatttaaccccggggtaacgttaaccgtttaaaaacggtttaaccccgtaaacggttttaccccggtttaccccggtaaaccggttttttaaccccccgggtttactttttaaccccgggggtaaaccccgggtttaaccggggtttaaaaccccggggttaccggaaaaccccggggttaccggtttaaaccccgggttaaaaggttaaaccccggtttaaaaaaaccggggttaaaccccgggtttaaccggtttaaggggtacccccgttaaaaccgggggtttcccctaaaaacccgggtttacgttttaccccggg

SEQ ID NO: 69121 - DNA, 819 bp, Homo sapiens
  misc_feature: GYAE6OF01A2TZ1.51.76.G10.1.454.CMB.1.raw
  modified_base (222)..(222): a, c, t, g, unknown or other
  misc_feature (222)..(222): n is a, c, g, or t
tcagcgatcgtatacacgaccggtgctcgatttagtcactcatacagggggaggaactgctcagttaggacccagacggaaccatggaacgccccagcgcagcttctcttcctcctcgctactctcggctacccagactaccactggagaagtagtgactagacgactagtctcccacgtccctacccttgttccttgtacgttcctaccgaaaggggaaanaccgaccctaccctcctcctacggaccgacgggtaccaagttcgaacggtagttagttacgctaacgcgtacgttacgtacctacggtaccagaccgaaacgtaaccgtcggaccaacggcctccgaacggtccctacctacgactctaacgtgacttcgaccacgtaccgaggtaccgggacctaggtccgaccgtaccgacgtaccgtaggttacacggtcgggacgtacgggttcggtaccgggtacggactaccgttaacgtaccgtacttacccgtaccgtaaccgtactaccgaacgtaccgtaaccggacctttaaacggacccgttaaccgtaacgggttaacgttttaacgtttacttaaacgttttaaactttaaccgttacgtaccggtaacgtaacgtaaccgttaggtaaccggttaacgttaacggttaccgtttaccggtaccccgtttaaccgtaccctacggtaccccgttcggtaacggtaaccccgggtaaagtaacccgtaacggaacgttaaggaaaccgtaaaaccgttaaacggacgtttacggtaccgtacctaaggtacccctacggttacc

SEQ ID NO: 69122 - DNA, 863 bp, Homo sapiens
  misc_feature: GYAE6OF01EE8FN.51.76.G10.1.454.CMB.1.raw
  modified_base (468)..(468): a, c, t, g, unknown or other
  misc_feature (468)..(468): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactgggaagaagtagtgatgacgcagtctccacgcccaccctgtctgtcgtactaccggaaggggaaacacgtccctaccccttcgtccctggaccgacggggaccctacggtactaggtaggttagttacgacaacggtccgttagttaccggcccgttacggtaaccgtaacgaaccgaaaccggtaaaccgtccgggacccgaccgggtccctaccccgaaccgggtcccttccccttacaacgttacgttaagtacgtaacgtccggacctaaccgttaaccgaaacccgggaacgggtacccctaacttaccggaacttacccnccccggaaccgtccggtaacggtttccgacgggtacggtacggtaggtacggggttcgttaacgggaaccgtaaggtaccgtttccgtaacgtttcccaaccgtaccgtaacgtaccacgtaccgacgtcccgttggtaaccgtcggttacgtaagtaacgttttacgtttacgttaaacgttttactttaacgttacgttacgttaacgtaacttaacggttaaattaacgtttaaaccgttaaccgttacccgttaaccccgttttaccggtaaccccgtttacgggtttacccgggaaaccggtacggggtaaaaccgcggttaacggtagtaaaccggtaactaccgtaaaccgtcgtacggtaccgttagtacgtacccctagttacccg

SEQ ID NO: 69123 - DNA, 1042 bp, Homo sapiens
  misc_feature: GYAE6OF01B9SWM.51.76.G10.1.454.CMB.1.raw
  modified_base (204)..(204): a, c, t, g, unknown or other
  misc_feature (204)..(204): n is a, c, g, or t
  modified_base (650)..(650): a, c, t, g, unknown or other
  misc_feature (650)..(650): n is a, c, g, or t
tcagcgatcgtatacacgaccggtgctcgatttagtcactcatacagggggaggaactgctcagttaggacccagacggaaccatggaagccccagcgcagcttcctcttcctcctgcctactcgtggcctccagactaccactggagaagtagtgatgacgcacgtactccacgcccacctgtctgtgtctcggaaggggaanacgccaccctctccgtgcgacggcctagtcaaggtgtagtacgcgagcgtacttggcctcggtaccagaccgaacgtaaacccggcggacccgacgtcccgtacccgacggtccccttccttacgtacttaccgtaacggtcggtactaccggtaccctaaccgttaacccggaaaccgggtaaaccggtacccgttaaaccgtaacggtaaaccccttacccggtacccccggtaaacgggttaccccggtttaacggtttacccgggtaagggggttcggggaacccggggtttagggggtttaccccggggggtttcgggttaaaccggggaaaccccggggtttaaagggttaacccccttttaccggtaaccccggtttaaccccggtttaaccccgaaaccgttaaccctccgggaaaacccgtcccggggttaaccccncccggggttttaccgaacccgggtttacggttaaaccgttaaaagggttttaacccgtttttaaagggttttcccttttaaacgtttttaaaaccgttttccgggttttaaccgtacgttttaacccgggaaccgttaagtttaaaaccgttaaacccgttttaaaaccggttccggttaaccccggtttaaccccgggtttaaccgtttaccccggggttaccgttttaaaccccgggggaccggggttaaaaccccggaaaacccggttaaggggtccggtttaaaaagggaccccgggtttaaaaagtaaacccggggttaaaacccgttgggggttaaccccgggttcgaaaaccccggtcccttacccgggttaaacgttttcccgg

SEQ ID NO: 69124 - DNA, 771 bp, Homo sapiens
  misc_feature: GYAE6OF01AE54J.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccacgtggagaagtagtgatgacgcagtctccacgcccaccctgtctgtgtctccgaggggaaagcgcccaccctctcctgcgacgggccagtcagtagtagttagcacgcgtacttacgccgtacggtaccaggaccaacggaaacccgtcgggcccgacggtcccgtccccgacgggtcccttccctactacttccttagtgtactacgccacctacccgaacggtaacgggcctacgtacgaactacccgacccgtacggtaccgtacggttacgacgggtgggtcggtaaggggtcgggttacggtacgggtaacgtacgggttaccgtttactacccgttacctacccacgtacgtacgacgccgtacgccgtagaccggttacgttcgttaaggttaacgttttaacgttttaggtaaacctttttaagttttaactttaccgttacggtttaacgaacgttacgttaaacgtttaacgtttaaaccggttacggttacccgttacccggttacccgtttacggtttaccggtttaccgggaccggtaacccggggaaccgtacggtcggtaggaaacgttacgtaaccgtaaacggtcgtacggtcgtaccgacgtccgtaccgttacg

SEQ ID NO: 69125 - DNA, 825 bp, Homo sapiens
  misc_feature: GYAE6OF01D828U.51.76.G10.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
tcagcgatcgtatacacgaccggtgctcgatttagtcactcatacgagggggaggaactgctcagttacggacccagacggaaccatggaacgccccagtgcagcttctcttcctcctgactactctcggctcccagactaccacgtggagaagttgagactgacgcacgttccaccagcccgtacctggtctgttcgtcacggagggaaacncgcccctcctcncctggccacgggtccagtcagtacgtgtcgccagtcgtacttcggcgtaccggtacncgacgaacgtaaccgtcgaccgccgtccnccgtacgtcctcgtactactctagtcgtacgtacgacaacctaccggtacgaccgggtacctaggttaccacgtacccgtaccgaccggtacggttcgtaggtaacgcgggtaacggtcgggtacggttcgggagggtaaccgtacgtaccggtttcccgaccgttctaacccgtacgtacctacgtaccgtaccgtccggtaccggtactacggtacgttaacggtacggtttaacgttttacgttttaacgtacgttttttaacttaccgggttttacttaaccggttaccgttaaggtaaaccgttttaaaaccgttaaacgtttaaacccgttaaccggtttaccccgtttaacccgtttccggttaacccgttttaccgggttaccggttaaaccggggtaccgggtaaacgttaccgggttaaaccggtcggggtaaaacgttaacggaaaccggttacccgtagtttacccggtaccttaccgtacccggtttccgtaccgttaccg

SEQ ID NO: 69126 - DNA, 913 bp, Homo sapiens
  misc_feature: GYAE6OF01AFSWX.51.76.G10.1.454.CMB.1.raw
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccaccctgtcctgtgtcctccgaaggggaaacgcgaccctaccctctcctgcgacgggccagtcagagtgtagcgagccgtacttacgcctacggtacacgactaacgaaccgtcggaccgacggtcctcccgacggccctcctactacctcgttaagcgtacttcgaccgtaaccgtacccggaaacggtaaccgggtacccgtacgtaacggtaacccgtttaccacccccggtaacggtacccgggtaccggtttacgtaaaccggggttggaccgggttaaggtttcgggggttccggtagggggtaactacgggttaccgtttaccgtacccgttacctaccccgaacgttacgtacccggtaaggtacccgtaacggttccctaccgaacgggtttaaggttacccgttaaacgggtaaacgttttcgttttaaccgtaaaacgttttaagttttttaacccgaccgttttacggtaaaccgtacgggtaactttaaaaccggttaaaacgtttaaaccccgtttaacgggttacccccgggtttaaccgttttaaccccgtttaaccgttttaacccgggggttttccggaaacccgggggtttaaaccggggaaccccgtttaaagggtcccgggtaaagggttaaacggacgggtttaaaaaccccgtaaacggtcccgggttttaacgggtaaccgggttacccttaccgaaccgtttacccgggttaacccg

SEQ ID NO: 69127 - DNA, 951 bp, Homo sapiens
  misc_feature: GYAE6OF01AZ2VN.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtcgtctccgaggggaacncgccctaccctctccgtgccgagggcccagtcaggtagttgtagaccagcgtacttacgccgttacggtacccagtcgaacggtaaacccgtcggacccgacgggtccctacccggacggtcccttaccctactacttacctagtacgtacgtcgacctacgtcccgaaacggaccgggtacctacgttacgaacttaccgcccggacgtacccggttaaggttcgaagggtcgggtaccggtagggttacggggttaccggtacggggaaaccgttacggtaccgttttacccgtacccgttaccctacccgtaaacccgtaccgttaaccgtaccgggttacccgtaaccggtcccccggttacggtaacccgtttaaccggttaccggtttaaaccggttaacgggttttaaaccgtttttacggttaaaccctttttaaacgtttttaacccgtttaaccggtttaccggtaaccgttaacgtttaaaccggtttaaacgtttaaaacgtttaaaacccgggtttacccggtttaaccccgggtttaacccccgtttaccggttttaaacccgttaccccggggtttttaaccggggaaccccggggttaaaaccgggggttaacccggtaaccgggttacgggttaaccgggtaacgttaaaccgttaaacccgggttaaaaccggttaacgttaccgggggtaacccgttaccgtaacccggttaccccgttaaccgggttacccg

SEQ ID NO: 69128 - DNA, 692 bp, Homo sapiens
  misc_feature: GYAE6OF01EC7LG.51.76.G10.1.454.CMB.1.raw
  modified_base (193)..(193): a, c, t, g, unknown or other
  misc_feature (193)..(193): n is a, c, g, or t
  modified_base (574)..(574): a, c, t, g, unknown or other
  misc_feature (574)..(574): n is a, c, g, or t
tcagcgatcgtatacacgaccggtgctcgatttagtcactcatacaggggaggaactgctcagttaggacccagacggaaccatggaagccccagcgcagcttctcttcctctgctactctgctcccagataccactggagaagtagtgatgacgcagtctccagccacctgtctgtcgtctacgaagggaancgcctacccgtctcctggacgacgggccagtcaggtagtaggttacgcacgtcgtaacttaccggccgttacggtacgaacgaccgtaaaccggtaaaccgtcggacccgtacgggacctacccgacgggttccttacctacctaacgttacgtacgtggtacgttcgacctaaccgttccggaaaccggtaccgggcctaacgttacgtaaccgtacctaccggacgtaccggttacggttacgtcgggtacggcgttaggggtcggtaaccggtggaacgttacgacgtttaccagtccctaacggactagtaccacgtcgaccgtactcgacctaggtctaacgtagttcgtttagaactttagttcttagtacgtanacgtagtaacgttaagtctacgttcgtacctaccgttacgttacgttacggcggaaacgtcgtaagtcgggtaagaggtacaaccgtaactacggtcgacgtacctctaacgtctacg

SEQ ID NO: 69129 - DNA, 728 bp, Homo sapiens
  misc_feature: GYAE6OF01BETDM.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtgtctaccgaggggaancgccaccctctcctgacgacgggccaggtcaggtagtagttacgcagccgacttacgccgttcggtaccagcgaacgaaccgtcggaccacggccgtcccgagggcctcctacctactactaactcgtagtagcctactaccgaacggacgggaccacgtcgaacttacctaccacggtccgtaggttcgaggtcggcgtagggttacggggtcgtacgggacgtaggtacgttacctactaccgtaccacctactcgaacgcacgccctggaccgtaggtcgttaagtacgttaagttttagaacgtttaattttaacgttacgttacgttaactagtacgttaagttaacgttaaacttaaccggttaccggttaacccgttacgtttaacccgtttaccggtttacgggtaacccgggtaaccgggtaaccgaacccgggttacgtaagggttaaccgtaactaaacccggtaaaacccgtacggttaaccggtacgggttataccggtaccgtaacccgttaccgg

SEQ ID NO: 69130 - DNA, 797 bp, Homo sapiens
  misc_feature: GYAE6OF01EMY0V.51.76.G10.1.454.CMB.1.raw
  modified_base (165)..(165): a, c, t, g, unknown or other
  misc_feature (165)..(165): n is a, c, g, or t
  modified_base (229)..(229): a, c, t, g, unknown or other
  misc_feature (229)..(229): n is a, c, g, or t
tcagcgatcgtatacacgaccggtgctcgatttagtcactcatacgagggggaggaactgctcagttaggacccagacggaaccatggaacgccccagcgcagtcttcctcttcctcctgcctatctggctacccagtactaccactggagaagtagtgatgacncagtcctcagtcccaccttgtactcgttgtcctacggaaggggaaacgcgcccctaccccgttntcccgagccgtacggggaccagtacgaggtgtgttacgcagtaccgttacgtacgccgtacgtaccaacgacgtacgtaaccgtcggaccgtacggcctacccgaggtccctctactagttactatgaactgaccgtactacccgaacggtaacgggcctaacgtagtaccttacccgaccggtaacgtaccgtacggtttacaggggtacggttcgaacggggtttgggtccgtacgggtaagtacgggttacttccgtaacctttaccacccgtaaccttacgtacctaaccggtaccgtacgtaccggtacggtacgtacggtttaccggtaagttaacgttttacgtttaacgtaacttttaaaccgtttacttacgttacgtacgttaacggtacttaaacggttaaccttaaccgggttacctccggggtttacccttaccggttacccggtttaggttaaccggtaccgggtaaggtaaccgtaacggttaccgttagggtaacgtaacgtaaccgtaaacgtacggttacgtacggacccgttctaccgttcgttacccg

SEQ ID NO: 69131 - DNA, 850 bp, Homo sapiens
  misc_feature: GYAE6OF01A2H00.51.76.G10.1.454.CMB.1.raw
  modified_base (214)..(214): a, c, t, g, unknown or other
  misc_feature (214)..(214): n is a, c, g, or t
tcagcgatcgtatacacgaccggtgctcgatttagtcactcatacgagggggaggaactgctcagttaggacccagacggaaccagtggaacgccccagcgcagcttctcttcctcctgctactctggcctcccagactaccagtggagaagtagtgatgacgcagtcctaccacgccctacccgtgtctgtcgtcgtaccggaaggggaaacnccgccctaccctcctccgtggcgacgggcctagtacgaggtagttagttacgcgacggtacgtacgttacgccgtacggtaccagaccgaacgaaccgtcggaccgacggtccctcccggacgtccttaccgtacgtactcgtaacgtcgtacttccggacctaccgtaccgaaccggtaaccggtaccctacgtacggtaacttaccccgcccggtaaacggtacccggttaagggttccgaggggttacccgggagggttacggggttccggggttaacgggtaaccggggtaattaccgggtttaaccgtaaccctccggttaccgtaacccctaacgtaccgttaacccggaacgtccgtaacccggtacgtaacccggttcgttaacgtaaccggtttaaggtttaacgttttaacgtttacgttaacttttaacgttttaccgttacgttacgtaaccgtaagttaaccgtttaacgttaaacctttaaaggtacccgttccggttaaacccttaccgggttaacgttccggttaaccgggaaccgggtaacggtaaccgtagggtaccgttaagggactaaacgtaacccgtaaggtaacccgtgacgttaccacggtaactcggttac

SEQ ID NO: 69132 - DNA, 703 bp, Homo sapiens
  misc_feature: GYAE6OF01DG9ET.51.76.G10.1.454.CMB.1.raw
tcagcgatcgtatacacgaccggtgctcgatttagtcactcatacagggggagtaactgctcagttaggacccagacggaaccatggaagccccagcgcagcttctcttcctcctgctactctggctcccagataccactggagaagtagtgatgacgcagtctccagcccaccctgtctgtgtctccgaggggaagacgcccaccctcgtcctcgcagggccagtcgagagtgtagcagcgatacgcctaggtaaccagacacgaaccgtcggacccgaggcctcccgaggcctcccgtcattcgtactgagtcgacacttaccaacgtaacgggaccctacgtagtaactacgtaccccacgtaccgtacggttactaaggtcggacggtagggtagggttacccggttaggggaccgtacggtagtttcccgtaacctcccgttaccgacctaccgtaccacggtaccaccgtcccgttacggactacgttaccggttaattaaggttacttttacgtaccgtttaaattttacgtttaacttcgtactaacgtacgtaagttaacttaacgttaaccgtcgttaccccgttaccggttaccgttaaccgtttacgggtaccccggagggaacccgtaagaccggtaagaacgtacgtaaactaaaccgtagtcggttacgtagtcgaccgtacgttacg

SEQ ID NO: 69133 - DNA, 779 bp, Homo sapiens
  misc_feature: GYAE6OF01BOJJC.51.76.G10.1.454.CMB.1.raw
  modified_base (244)..(244): a, c, t, g, unknown or other
  misc_feature (244)..(244): n is a, c, g, or t
  modified_base (546)..(546): a, c, t, g, unknown or other
  misc_feature (546)..(546): n is a, c, g, or t
  modified_base (588)..(588): a, c, t, g, unknown or other
  misc_feature (588)..(588): n is a, c, g, or t
tcagcgatcgtatacacgaccggtgctcgatttagtcactcatacgaggggggagaactgctcgagttacggacccagaccggaaccatgggaacgcccccagccggcagtctttcctacttcctacctgccttacgtcgtcggcctacccagactaccacgtagggagtaacgttggtgactggaccgctacgtcctaccgacgccctaccttgtctagttcgtaccgtacggaaggggaacnccgtcccctacctccgtcgagccggacggctagtcgaggtagtagttcacgacgtccgtacgtacgtaccctaggtaaccacggactaaccggtaccgtcgggaccgtaccgggtccaccccggtagcccttaacctcgtacgtttcctaagggttcaccgggttcaacccggtaacctacccgggaacggtaacccgcgtttaacgagttacccgtacccctaccgacgtaccggtttaggaccgttaggccggtacgtaggtcgggtaccgtaaggcttacggttacctctacctccaanaccgtatcacggcctacgtcgctacgtcgtagtactactttnttaacgtacgtttatacgtcgtagtacgacgttacgtattaaccggtaccgttcgtaccgtttaccctaaggttacccgttaccggttacgggaaccggtaccgtaaccgttaggtacgggttaacggaccttacggaacccggttaacgaccggttcgggaaacttccgaacccggtacctacgtttccg

SEQ ID NO: 69134 - DNA, 810 bp, Homo sapiens
  misc_feature: GYAE6OF01BYP58.51.76.G10.1.454.CMB.1.raw
tcagcgatcgtatacacgaccggtgctcgatttagtcactcatacaggggggaggaactgctcagttaggacccagacggaaccatggaagccccagcgcagcttctcttcctcctgctactctggcctcccagactaccactggagaagtagtgatgacgcacgtcctccacgcccacccgtgtcgtgtcgtctaccggaaggggaaacgccgtccctaccctcctccgtgaccgacgggacctacgtacgagaggttgtaacgcgtagtcgtacgttacggtccgtacggtaccacggtacgaacggtaaacccgtcggaccgtaacggtccctacccggacggtccctaccccgtactacgttacgtacgtacgtagtaccggtacctaaccgtaacccgtaaaccgggaaccgggtaccctaaacgtacggtaacttaacccgtaccccgtaacggtaccgttaaggttaccgtacggggtcggtacggtacggggttcggggtacgttaacgggaacgtaacggttaccggttacctaccgttaccctaaccgtaacctaacgtccgaacggtccgaaccggtccgtacgtacgttaacggtctaaagggttaaatttcgttttaactaagttttaaactttacgttaagttcgaactaccgttaataaacgttaacttaacgtccgtacggttacccttaccggttacttaacccgttcggggaaacgtacggggtaaacctagggtaccgtaaggaccgtaataaacccggagtacgttcgggacaccgtccgactccttacg

SEQ ID NO: 69135 - DNA, 782 bp, Homo sapiens
  misc_feature: GYAE6OF01B2PEH.51.76.G10.1.454.CMB.1.raw
  modified_base (91)..(91): a, c, t, g, unknown or other
  misc_feature (91)..(91): n is a, c, g, or t
  modified_base (209)..(209): a, c, t, g, unknown or other
  misc_feature (209)..(209): n is a, c, g, or t
tcagcgatcgtatacacgaccggtgctcgatttagtcactcatacagggggaggaactgctcagttaggacccagacggaaccatggaacnccccagcgcagcttctcttcctcctgctactctggctcccagactaccacgtggagaagtagtgatgacgcagtcctccacgcccaccctgtctgtcgtcctaccggaaggggaaacncgcccaccccgtctccgtgccgacgggcctagtacgagtagtgtacgcaagccgtaattcgccgtacgtaccagcaacgaacctcggccaggcctccgacggtcctcctctatctagtcgatcgacactacccgaacggaacggtaccctagtacgtactaacccgtacccgtacgtaccggttaaggtaccgagggtaccgggtcggtaggggtttacgggtacggtaaccggggacgaacggttaccgttaccaccttcccgtaaccaccgtaactccgacgaccggtacgcccgttagaccgtacgttacgtaaacgggtttaagtttacgttttaggttaaaccttttaaagttttacgtttaaccgttacggttactaacgttaccgtttaaagttaaaaccggtttaacgtttaaccccgttaccggggtttaacccctttaccggttaaccggtttaccggtttacgggaacccggggtaaaccgggaccgtacgttacggtaacggtaacgttactaaacgggtaaactaacgggtgttacgtaccctcgtaacccgtcgtaccg

SEQ ID NO: 69136 - DNA, 692 bp, Homo sapiens
  misc_feature: GYAE6OF01EEY9P.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtgtctcgaggggaaagcgcccaccctctcctgcgacgggccagtcagtagtgttacgcgacgcgtacgttacgccgttcgggtaaccaggaccgaaggtaaacccgtcggacccgacggcctacccgaggtcctccgtactagtcttagtgatcgcctactaccgaacgaacgggcccaacgtacgtaactacctacccgacggtaccgtacggtttcgacggtcggacgtagggttcgggttacgtacgggaacgtaggtacgttccaaccgttcctacctacctagtccgacgctacggcctacggactaggttactacggtaagttttacgtttacgaacttttaaattttaccgtttacgttacgtccgaacgtcttaaaggttaaacttaacgttacgtccggtaccttaccttacgttacgttacggaccggtaacggtacgtacggtcggtaggaagtaccgtaacgtaaacggtcgttggtaccggatacgccgtacgttacg

SEQ ID NO: 69137 - DNA, 883 bp, Homo sapiens
  misc_feature: GYAE6OF01ASIDJ.51.76.G10.1.454.CMB.1.raw
  modified_base (166)..(166): a, c, t, g, unknown or other
  misc_feature (166)..(166): n is a, c, g, or t
tcagcgatcgtatacacgaccggtgctcgatttagtcactcatacagggggaggaactgctcagttaggacccagacggaaccatggaacgcccccagcgcagcttcctcttcctcctgctactctggcctcccagactaccacgtggagaagttagtgatgacgnagtcctacccacgcccacccgtgtctgtcgtcctaccggaaggggaaacgacgcccctacccttccgtcccgtggaccggacgggccagtcgagtaggttgtagcgacggtaccgtacgttacgcccgtacggtaccgacgaccgaacggtaaaccgtccggacccgacggacccgtacccgtacggtcccttcctactacttcttagtgacgtcacctactacccgaacggaaccggtacctacgtacggtacctaccgtacccgacgtaccggttaacggtccgtacgggtcgggacgtacggggttcgggttacggacgggtaacgtaaccggttcgttaccctaaccgttcccgtaacctaacccgtaccgtacggaccggtactacccggttcccgtacgtaaccggttacgttacggttaacggttaacgtttacgttttaaccgtaactttttaactttaccgttaacgttaccgtaacgttacggtaacgttaaacgtttaaccgttaaaccggtttacccggttacccgttaaccccgtttaaccccggttttaacggtttaaccccgggttaccggggtaacccgggttaaccgggaaacccgttacgggttaacggtaacgggttaaacgtaaacggttaaaccccggtaaacgggtttaccgacggggttaccggtaccggtaccctaaccggtacccttaccgg

SEQ ID NO: 69138 - DNA, 836 bp, Homo sapiens
  misc_feature: GYAE6OF01DJPNG.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggcctccagactaccacgtggaagaagtagtagatgacgcagtcctccagccctaccctgtctgtagtcctaccggaaggggaaacgacgccctacccctctccgtgacgacgggcctagtccagtacgttgtagcagtcgtacttacgccgttaggtaacccagacgaacgtaaacctgaacccgtacggaccctcccgaacgggtcccttaccccgtactaactttaccgtaagtacggtacgttacggacctaaaccgttaccccgaaacggggtaaaccggggtacccctaaaccgttagggtaaacccttaaccgtacccccgtaaggtaccccggttaacgggttttacgaaccgggttaccggggacccttaagggggtttcgggtacccggttaagggggaacctagggttaccgttaccgtaacccttcccgtaccgaaccctaagtaccgaccgtacgtaccgaccgttgaccgtaagtaccgtaaggtacgtttatttacggaactttaatttacgttacgtacgtacgaacgtattaacgttaacttaacgtaaccgttccgtacctttaacccggtactttaccgggtttacccggtaaccgggaccgggtaacttaacgggcttaagggaacgtaaccgtaaacgtaaaccggttaccggtacggttacggacccttaacggacccctaagttaacccg

SEQ ID NO: 69139 - DNA, 913 bp, Homo sapiens
  misc_feature: GYAE6OF01E23R6.51.76.G10.1.454.CMB.1.raw
  modified_base (210)..(210): a, c, t, g, unknown or other
  misc_feature (210)..(210): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggcctcccagactaccactgggagaagtagtgatgatgcagtcctccacgccctaccctgtctgtcgtctaccggaaggggaaacncgcccacccttctccgtgcgacggccagtcagagttgtacgcagcgtacttacgccgtagtaccacgacgtaacgaaccgtcgggaccgacggtccctaccggacgtcctacccgttacaacgttctagtacgacgtcgacctaaccgtccgaaaccggaaccgggcctaacggtacgtaacctaccgtacccgtacggtacccgtagggttccgaggggttccggaccggtttagggttcgggtacgtacggggtaaacctacggttacgttacccaacccgtttaccgtaacccgtaaccccgacgttaccgaacccggtaaccgttacccgggtaaccccggttacggtaaccgttaaacgggttaccggtttaaacggttaaacggtttttaacttttaacggtaaacctttttaaacggttttacccgtttaaccggttccgggttaacggttaaccgttaaacgggttaacgttttaaacgttaaaaccggtttaccccggttacccggtttaaccccggtttaaccgttttaaccgggtttaacccgggtttacccggggtaaaccccggggtaaacggggtaacccgttaaaggggtccggttaaacgggaaacgttaaacccggaaaacccgttaaaaaccgggtttaccgggttacgggttaacccggtaacggtcccttaaaccgggtcccc

SEQ ID NO: 69140 - DNA, 727 bp, Homo sapiens
  misc_feature: GYAE6OF01A8S83.51.76.G10.1.454.CMB.1.raw
  modified_base (205)..(205): a, c, t, g, unknown or other
  misc_feature (205)..(205): n is a, c, g, or t
  modified_base (484)..(484): a, c, t, g, unknown or other
  misc_feature (484)..(484): n is a, c, g, or t
  modified_base (525)..(525): a, c, t, g, unknown or other
  misc_feature (525)..(525): n is a, c, g, or t
  modified_base (716)..(716): a, c, t, g, unknown or other
  misc_feature (716)..(716): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagactaccactggagaagtgtgatcgacgcacgtcgtccacgcctaccctgtcctgtcgtctccggaaggggaacncgcccacctcgtcctcgaccgacgggtacctaggtacaaggtagttcggttaacgctacgtacggtaacgttcggcctacgggtacctaggacgtaaaccggtaacccgtcgggaccgtacggcctaacccgtacgggtcctaccgtactacttacgtactaggtactcggtactaaccgtaccgaacggacgggtaaccacggttacgacttaaccgaccggaccgtaccgggttacggtacgtaacgtcgggaacgtcgggtcgggtaggacggtanaacgggttcttaaccgctaccgtacacgtacacgtacgacncggtctaggctacgttacgtaagtagtttaacgttactaacgtttaacgtttacgtacgttacggattacgtaagtaacttaaactaccggtacgttacgtaccttccggttaaccgtcgttacgggaacgtccggtaaactacggtcgtaaggacttacgaaaccgtacgacgtcggtacgtaccgtacncgttactaccg

SEQ ID NO: 69141 - DNA, 754 bp, Homo sapiens
  misc_feature: GYAE6OF01A02MU.51.76.G10.1.454.CMB.1.raw
  modified_base (147)..(147): a, c, t, g, unknown or other
  misc_feature (147)..(147): n is a, c, g, or t
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
tcagcgatcgtatacacgaccggtgctcgatttagtcactcatacagggggaggaactgctcagttaggaccagacggaaccatggaacgcccagcgcagtcttctcttcctcctgctactcgtggctcccagactaccactagganaagtagtgatgacgacagttctaccacgcctacctgtctgtgtctaccgaagggaacncgaccgacctcgtccgtgcgacgggcctacgttacgngtagttgtaacgcacgcgttacngtaccggtcgtacacgtacgaaacgtaaccgtcggacccgaagtcccgttaccgacggttccgtaacctgttacgttaccgagttcgaactcggacgtaccttacggaaccgaccgttaccgacgttaacgaccgttaccacccgtacgtcccggttaacggttacgtacgggttcgggaacgttcggtcggggtttaccgggaacggtacgaaacgggtttcggttacccctattaccccggtacaaaccctggtaaccgtacgtacgtacgtacgtcgtacgtagtcgttaacgtaagttacttacgtaaactttattaacgttcgtaacgtactacgggtaactaacgtaacgttaacgttacgtaccgttacgtttaccgagtttaccggttacggacggtaaccggttacgtaacgggtccaaggttacgaaaccgttacgtaaacgttcggtacggtaccgtagaccggtacgtacccgttag

SEQ ID NO: 69142 - DNA, 942 bp, Homo sapiens
  misc_feature: GYAE6OF01ARBLF.51.76.G10.1.454.CMB.1.raw
  modified_base (223)..(223): a, c, t, g, unknown or other
  misc_feature (223)..(223): n is a, c, g, or t
  modified_base (263)..(263): a, c, t, g, unknown or other
  misc_feature (263)..(263): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacgagggggaggaactgctcagttaggacccaggacggaaccatggaacgccccagcgcagtcttctcttcctctgctactctggcctccagactaccactggaagtagtgtgatgacgcacggtcctccacgcccaccgttgtctcggtacgtccgtacggaaggggaaaccgtccccncctcgccgtggacgcgggacctagtccgtaaggtcggttntacggacgtacggtcgttaacgttacgcccggttacggaccgtagaccgtaacgtacccgtcgggccctacgggtaccctcccggaggtaccccttaccccggttanaccgtttaaccgtaggttaaccgtaccgtccggacccttaaccggtaacccgaaaccgggttaaccgggaacccctagtttaaccggaacctttaacccgaccccgtaaccgggtaccgttaccgggttacccggtaaagggtcggtaaccccggggttgggggtttaaccccggtaacgggttaaccgggaaaccggtacggtttaaacccgtttcccggtaaaccgttcccgtaaacccggtacgttacccgggtaccgtaaccgggtaccggttaacccggttccggtaaccggttaaccgttaaacgggtttccgtaaaggtttacccgtttacggttttaaccggtaccgttttaaagttttaacgttcccggtaggtaaacccggttaagtaccgtttaaaggttaccgtaaaccgttcggggttacccttaccgtaaccggttacgttaccgggttacggaaccgggttacacccgggtcgttaacgggtacggtaaccgacggtttaacccggaaacggttcgtaccgggttacgtacccgtaccgttaccgtaaacgggttcc

SEQ ID NO: 69143 - DNA, 842 bp, Homo sapiens
  misc_feature: GYAE6OF01A82UX.51.76.G10.1.454.CMB.1.raw
tcagcgatcgtatacacgaccggtgctcgatttagtcactcatacgagggggaggaactgctcagttaggacccagacggaaccatggaagccccagcgcagcttctcttcctcctgctactctggctcccagataccacgtggagaagtagtgatgacgcagtctccagcccacctgtctgtctacgtaccgaaggggaaacacgccccaccctctccctgaccgacgggccagtcgagtagttcgtagcagtccgtattacgcccgttacggtaacccagaccgtaacggaaacccgtggacccgacggccctaccgacggtcccttacctacctacttacttacgtagtacgtcgacctaacctaacccggaaaccggtaaaccgggtaccctaaacgtacggtaacccttaaccccgtaccccggaaccgggttacccgttaagggtttaccgtagggtacggggtacgttaacggggtttcggggtaccgttaggggaacttacgggacggtttttaaccaccgtttaccgtaacccaacctaccgttacgaaccggtcaacccggtactcggaaacgttacgttacgttaaggttaacgtttacttttaacgtaacgtttttaacgtttaacgttaccgtaagtaccgtaagttaaccgttaaagttaacgttaaacgtaccggttaccgtacccgtttaacccgttacggtttaaccggttaccggggtaaacccggtacgggaaaacccgtacgggttaaccggaacgggttaacaacgttaaaccggtaaaccctaggtacccggtacgggttaccaccgtcctacgttaacg

SEQ ID NO: 69144 - DNA, 897 bp, Homo sapiens
  misc_feature: GYAE6OF01CNVQB.51.76.G10.1.454.CMB.1.raw
  modified_base (214)..(214): a, c, t, g, unknown or other
  misc_feature (214)..(214): n is a, c, g, or t
tcagcgatcgtatacacgaccggtgctcgatttagtcactcatacagggggagaactgctcagttaggacccagacggaaccatggaacgccccagcgcagtcttctctcctctgctactcgtggcctccagactaccactaggagtaagtgtagactgacgctagtcctaccgagcccctacctgttcgtcgtcgtcgtaccgaaggggaacncgaccctacccgtcgtccgagaccgacggaccagtcgagtgtagtacgacacgtacgtactacgtccgtacgacgacgacgtaaccgaccgtcgaccgtacggccctaccggacgtaccctcgtactattaacgtagtacggtctaccgaactaccgtaccggaaccgtacggtacccgtaacgtacgtaaccgtaaccccaccggtacgtaccggttaggtacccgttacgggtacggtaccgggtttaggggtacccgggtcgggtaaacggtacgtaacggttaccgttaacccgtaccttaccgaccgtaacccgtccgtaacggaccggtaacccgtaccggtaccgtaccgtcggttaacggtaccggttaagttaaccgggtttaacttttaacggtttaccgttttaaaaccggttttgttaaccgttacgggtaacccttaaggtttaaaccgtttaaagttaaaccttaaccccgggtttaccgttaccgttccccggtttttaaacccgtaaccgggtttacccgttaccggggtaaccgggtaaaccccgggtaacaaccgggggttacccgtaaagggtaaccgttaaacccgggtaaacggttaacccggttaacggtccggtttaacccggtacgttaaacccccggtcccgtaaagtttaaccccgg

SEQ ID NO: 69145 - DNA, 736 bp, Homo sapiens
  misc_feature: GYAE6OF01DTJ2X.51.76.G10.1.454.CMB.1.raw
  modified_base (208)..(208): a, c, t, g, unknown or other
  misc_feature (208)..(208): n is a, c, g, or t
  modified_base (682)..(682): a, c, t, g, unknown or other
  misc_feature (682)..(682): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagactaccactggagtaagtagtgatgacgcagtcctccacgccctacccttgtctgtcgtcctacggaaggggaaacncgccctaccctctccgtggacgacgggccagtcgagtagtgtacgcagcgtactacgccgtagaccagacaacgtaaaccgtcgaccgacgtcctcccgacggtcctcccgtactaacgttccttaagtcggaacttcgtacccaacgttacccgaacggtaccgggtaacctaacgtagtaacctacccgtaccgaccgtacggttacggtacgacggtaccgtacgggtaacggtttcggggtaacggtacggtaccggaaggtttccgttaaccaacccgttttccgaacccgtaacctacgttacccggacgtaaccggacctaccggttcgaacttacgtacgtagttaacgttagtttacaactttaagtttaccgtatcgtatacggtaacttagttaactaacgtacgtccgttacccttaaccggtacttaaccgggttacgacccggtaagggaaccgtacggnttaacgggagtaacctaacgtaaacggtcgtaggtcagtaccctacgcctttag

SEQ ID NO: 69146 - DNA, 483 bp, Homo sapiens
  misc_feature: GYAE6OF02IVL0K.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgagtattttgctaatttattactgtcagctagtataataactgcctcgtactactttggccagggaccagctggagatacaacgactgtggctgcactac

SEQ ID NO: 69147 - DNA, 483 bp, Homo sapiens
  misc_feature: GYAE6OF02JC6OL.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagatttgctaatttattactgtcagcagtataataactgcctccgtactactttgccagggaccaagctggagatacaaacgactgtgctgcacctac

SEQ ID NO: 69148 - DNA, 486 bp, Homo sapiens
  misc_feature: GYAE6OF02HH641.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtattttgactaatttattactgtcagcagtataataactgcctcgtactactttgccgagggaccaggctaggagtatacgaacgactgtggctgcactac

SEQ ID NO: 69149 - DNA, 493 bp, Homo sapiens
  misc_feature: GYAE6OF02JCKB0.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatactcccagccaggttcagtggcaggtggtctgggacagtagttcactctcaccatcagcacgcctgcagtctagaagtatttgactaatttattactgtcagctagtataataactgtcctcgtactacgtttgccgagggacagcgtaggagatacgaacgacgtgtcgctcgacactac

SEQ ID NO: 69150 - DNA, 496 bp, Homo sapiens
  misc_feature: GYAE6OF02G066M.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtattttgctaatttattactgtcagtcagtataattaactggtcctaccgtactacttttcggccgtaggggaccaaggctaggagactacaacgactgtggctgcactac

SEQ ID NO: 69151 - DNA, 481 bp, Homo sapiens
  misc_feature: GYAE6OF02G8JMX.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtatttgctaatttattactgtcagcagtataataactgcctccgtacactttgccagggaccaagctggagatacaaacgactgtggctgcactac

SEQ ID NO: 69152 - DNA, 496 bp, Homo sapiens
  misc_feature: GYAE6OF02HR21M.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccatgatactccagccaggttcagtgcagtgggtctgggacagagttcactctcaccatcagcagcctgcagtctagaagtatttgactaattttattatgtacagctatataataactgccttccgtactacgtttggacctagggaccaaggctaggatatacgaaacgtacgtgtggctgccactacg

SEQ ID NO: 69153 - DNA, 506 bp, Homo sapiens
  misc_feature: GYAE6OF02JBWRY.51.76.G10.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccanaaggccactgatatcccagccaggttcagtggcaggtggctgggacagagttcactctcaccatcagcagcctgcagtctagaagtatttgacttaatttattacttgtacagctagtataataactggccttacgtactacgtttggaccgtagggaccaaggtcgtaggagtactacgaacgactggtacgctcgacaccta

SEQ ID NO: 69154 - DNA, 939 bp, Homo sapiens
  misc_feature: GYAE6OF02ISV5W.51.76.G10.1.454.CMB.1.raw
  modified_base (232)..(232): a, c, t, g, unknown or other
  misc_feature (232)..(232): n is a, c, g, or t
tcagcgatcgtatacacgaccggtgctcgatttagtcactcatactaggggtagggaactgctccagttaggacccagaacggaaccgagtggtaacgccccacggcgcagcttctcttcctacctgctacgtctggctcccagagtacctacgtggagagtagtggtactgtacgctagttactccgagtccacctgtcctagtgtctccaagggtaagagccacccggtntcctgccagggccgagtccagagtgttacgcctagcgacttagccttcggtacctacgcctacgtaaaccgtttgggcccaggtcctccccgagggtcctccctcgacttccctaagttcggaagtcgcgaagttccggaacgaaacgggggtcccaacgttagtagttaacggtaccccgtaagggaccccgtaaggttttccgaacggtttacgggttacctaagggtttcggggtacgttacgggggtaacccgtaagggaaacgggtttcccgaaacccgtttcccgttacccgtaaaccctaaccgtttaccccgaaacgggacccgtaaaccgggaccccgtttaccggtaccccgtaaacgggttaaccccgtttaacggtttaaaacggtttaaccgtttttttacgggaaccctttaaaacgtttttttaaacgtttaaaacccgtttacggttaaccgtaaacggttaccgtaaacggtttaaacgtaaaacgtttaaacccgttacgggttaccccttttaacccggtttaaaccttaaccggttttttccggggtaccccggttaacgggggttaacccctaaaacgggtacccggttaacggggtaaccgggtaaccgttaacccgtaaaaccgggtaaccgttacgggttaccgggtacccggtttaccgggtacccggtaacccgtaaccgg

SEQ ID NO: 69155 - DNA, 507 bp, Homo sapiens
  misc_feature: GYAE6OF02JVBFB.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctcatctatgatgcatccacaagggcccactgatactcccagccaggttcagtggcaggtggtctgggacagagttcactctcaccatcagcagcctgcagtctagaagtatttgacttaatttattactgtcagctaagtataatactgtcctcgtactacgtttggaccaggggtaccaggtcgtaggagactacgaaacgacgtggtacggtctcgacacctacg

SEQ ID NO: 69156 - DNA, 498 bp, Homo sapiens
  misc_feature: GYAE6OF02I1CCH.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggcctcccaggctcctcatctatgatgcatccacaagggccactgatatcccagccaggttcagtggcagtggtctgggacagagttcactctcaccatcagcagcctgcagtctagaagtatttgactaatttattactgtcagcagtataataactgcctccgtactactttgccgtagggaccaagcgtaggagaatacgaaacgaactggtaggctcgacacctac

SEQ ID NO: 69157 - DNA, 480 bp, Homo sapiens
  misc_feature: GYAE6OF02JE4N9.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtgcagtggtctgggacagagttcactctcaccatcagcacgctgcagtctgagtatttgctaatttattactgtcagcagtataataactgcctcgtactacgtttgcctagggacagcgtggagatacaacgactgtgctcgacactac

SEQ ID NO: 69158 - DNA, 499 bp, Homo sapiens
  misc_feature: GYAE6OF02I1195.51.76.G10.1.454.CMB.1.raw
  modified_base (195)..(195): a, c, t, g, unknown or other
  misc_feature (195)..(195): n is a, c, g, or t
  modified_base (314)..(314): a, c, t, g, unknown or other
  misc_feature (314)..(314): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatancccagccaggtcagtgcagtggtctgggacagagttcactctcaccatcagcagcctgcagtctgaagtatttgctaatttatactgtcagcagtataatactagcctaccgtactacgtttgaccgtaggggtaccaacggtctaggagacttacgaaacgaacgtgttaggctgaccacctac

SEQ ID NO: 69159 - DNA, 623 bp, Homo sapiens
  misc_feature: GYAE6OF02F09V6.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcgagggccagtcagagtgttagcagcgtacttagcctggtaccagcaagaaacctggccaggcctcccgaggcctcctcatctatgatgacactccaacgaacgggccactgatactcccagcctaggttcaggtggactagggtcgggtcgtgggaacaggtacgtttccaacttccgtaccaacctactaccgacgtcaacggtccctcgaccgtacgttccgtaggaacgttagttttacgacttaattttaattacgttgtacgtagtacctaagtaattaaacttaacgtcggtacccttaccgtaccttacgttttcggaccgtacgggaaccgtaacggtcgtaggtacgtaacgttaaccgaaaccggtacgttacggtacggacgtacggacctaccgtaacg

SEQ ID NO: 69160 - DNA, 502 bp, Homo sapiens
  misc_feature: GYAE6OF02I1I1S.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgctaatttattacttgtcagcagtataataactggtcctccgtactactttggcctaggggaccaaggcgtaggagtagtacaaacgaactggtaggtctggacacctac

SEQ ID NO: 69161 - DNA, 486 bp, Homo sapiens
  misc_feature: GYAE6OF02I38Q4.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtggcagtggtctgggacagagttcactctcaccatcagcagcctgcagtctagaagtattttgactaatttattactgtcagctagtataataactgcctcgtactactttggctagggaccagctaggagatacgaacgtactggtgctgcacta

SEQ ID NO: 69162 - DNA, 489 bp, Homo sapiens
  misc_feature: GYAE6OF02GXSJO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtggtctgggacagagttcactctcaccatcagcagcctgcagtctgaagtatttgactaatttattactgtcagcagtataataactgcctccgtactactttggcctagggaccaaggctaggagatacgaacgacgtgtaggctgcactac

SEQ ID NO: 69163 - DNA, 509 bp, Homo sapiens
  misc_feature: GYAE6OF02FXTLM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcacatcagcagcctgcagtctgaagtatttgctaatttattacttgtctagcagttataattaactggtacctccgtactacttttcggcctacgggacctaaggtcgtaggagatacgaaacgtacgtagtacggctcgacacctacg

SEQ ID NO: 69164 - DNA, 480 bp, Homo sapiens
  misc_feature: GYAE6OF02HYMZ5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcacatcagcagcctgcagtctgaagattttgcaattttattactgtcagcagtataataactgcctccgtacactttgcagggaccaagctggagatacaaacgactgtggctgcactac

SEQ ID NO: 69165 - DNA, 493 bp, Homo sapiens
  misc_feature: GYAE6OF02HHXVN.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtggtctgggacagagttcactctcaccatcagcagcctgcagtctgaagtatttgactaatttattactgtcagctagtataataactgtcctccgtactactttggccagggacctaaggctaggagatacaaacgactggtgtctgcacctac

SEQ ID NO: 69166 - DNA, 505 bp, Homo sapiens
  misc_feature: GYAE6OF02IF5SA.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgactaatttattactgtctagctagtataataactggccttccgtactacgtttcggaccgtaggggaccaaggcgtaggagatacgaacgtactggtaggctcgccactac

SEQ ID NO: 69167 - DNA, 483 bp, Homo sapiens
  misc_feature: GYAE6OF02GUIS8.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgagatttgctaatttattactgtcagcagtataataactgcctcgtacactttgcctagggaccaagcgtaggacgatacaacgactgtgctgccactac

SEQ ID NO: 69168 - DNA, 489 bp, Homo sapiens
  misc_feature: GYAE6OF02GW8U9.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggagggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgagtattttgctaatttattactgtcagcagtataataacgtgaccttccgtactactttgccagggtaccaggctggagatacgaacgactgtcgctgccactac

SEQ ID NO: 69169 - DNA, 500 bp, Homo sapiens
  misc_feature: GYAE6OF02I9PS9.51.76.G10.1.454.CMB.1.raw
  modified_base (195)..(195): a, c, t, g, unknown or other
  misc_feature (195)..(195): n is a, c, g, or t
  modified_base (347)..(347): a, c, t, g, unknown or other
  misc_feature (347)..(347): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtggtctgggacngagttcactctcgaccagtcagcagcctgcagtctagaagtatttgctaatttattactgtcagcagtataataactgcttcgtactactttgccgagggaccaaggtcctaggacgataccgaaacgacgtgtaggctacgtacgacctacg

SEQ ID NO: 69170 - DNA, 487 bp, Homo sapiens
  misc_feature: GYAE6OF02G2U48.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttcagtggcagtgggtctgggacagagttcactctcaccatcagcagcctgcagtctgagtatttgctaatttattactgtcagcagtataatactgtcctcgtactactttgccagggaccagcgtaggagtatacaacgacgtgtagtctcgcactacg

SEQ ID NO: 69171 - DNA, 512 bp, Homo sapiens
  misc_feature: GYAE6OF02JHVT8.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccaacaagggccactgatatcccagccaggttcagtggcaggtgggtctgggacagtagttcactctacaccatcagcacgcctgcagtctgaagtatttgctaagtttattactgtctagctagtataatactggtccttcgtactactttcgaccgagggtaccaaggtcgtaggacgatacgaaacgacgtaggtcggactgacacctacg

SEQ ID NO: 69172 - DNA, 487 bp, Homo sapiens
  misc_feature: GYAE6OF02FRM8T.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtatttgctaatttattactgtcagcagtataataactgtcctcgtactactttgcctagggaccaaggctaggagatacgaaacgactgtgctcgcacctac

SEQ ID NO: 69173 - DNA, 641 bp, Homo sapiens
  misc_feature: GYAE6OF02IAYHJ.51.76.G10.1.454.CMB.1.raw
  modified_base (147)..(147): a, c, t, g, unknown or other
  misc_feature (147)..(147): n is a, c, g, or t
tcagcgatcgtatacacgaccggtgctcgatttagtcactcatacaggggaggaactgctcagttaggtacccaggacggaaccgatggaagccccagcgcagcttctcttacctcctgctactctggctcccagataccactgganaagtagtgatggacgcagtctcagccacctgtctgtgtctccgaggggaaagacgccaccgtctaccgtgccgagggccagtccagagtgttacgcaaggccgtaatttcggcccttcggtaccgacgccagaaacctggccaggcctcccgaggctccgtcatcctagtcgtagtcgccacttccgaacgaaacgggccctaacgtcgtaactactacccgaacggccctagggttaccagggtcggacgtaacggttcggggtctacggggactaaggtacgtttccacgtctccgacctatcgacgcgagcccgtgcgtagtcgtaggtaagtagttttagacttaatttacttactgtcagtctaagtataattactaggtcctaccggttactacgttttcggaccgtacgggtaaccgtacggtcggtacgtagtaacgttaccgaaacgtacgttaaggtccggtaccgtaggtacctaccgtaacg

SEQ ID NO: 69174 - DNA, 495 bp, Homo sapiens
  misc_feature: GYAE6OF02IBMN0.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctgggacagagttcactctcaccatcagcagcctgcagtctgtaagtattttgactaatttatttactgtcagctagtataataactgcctcgtactacttttggcctagggaccgagcgtaggagatacaaacgactggtgctgcacctac

SEQ ID NO: 69175 - DNA, 493 bp, Homo sapiens
  misc_feature: GYAE6OF02GP5OX.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtgcagtggtctgggacagagttcactctcacatcagcagcctgctagtctagaagtatttgactaatttattactgtcagtcagtataatactcgtacctccgtactactttggcctagggaccagtctaggacgatacaacgactggtacggctgcactacg

SEQ ID NO: 69176 - DNA, 497 bp, Homo sapiens
  misc_feature: GYAE6OF02HLWAM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcacatcagcagcctgcagtctgaagtatttgctaatttattactgtcagcagtataataactgtcctccgtactacgtttcgccgtagggacctaggtcgtaggacgtagtacgaaacgactggtgctcgcactacg

SEQ ID NO: 69177 - DNA, 529 bp, Homo sapiens
  misc_feature: GYAE6OF02GW1UI.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggcctcctcatctatgatgcatccacaagggccactgatactcccagccaggttcaggtggcaggtggtctgggacagagttcactctcaccatcagcagcctgcagtctagaagtatttgactaatttattactgtcagactagttataatacgtcgtaccttaccgtactacgtttcggaccgtacgggacctaaggtcgtaggagtacgtaccgaaacgtaacgtggtacggactacggacctaccgtacg

SEQ ID NO: 69178 - DNA, 528 bp, Homo sapiens
  misc_feature: GYAE6OF02JB6DJ.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaacctggccaggctcccaggctcctcatctatgatgcatccacgaagggccactgatactcccagccaggttcagtgcagtggtctgggacagtagttcactctcacatcagcagcctgcagtctagagtatttgactaatttatacttgtactagtctaagtataactaactcggtaccttacgtactacgtttcggaccgtacgggacctaaggtcgtaggacgtacgtacgtaaacgtacgtcggtacggtctacggtacctacctacg

SEQ ID NO: 69179 - DNA, 537 bp, Homo sapiens
  misc_feature: GYAE6OF02FQSY2.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtcgtgggacaggagttcactctcaccatcagcagcctgcacgtctagaagttattttgacttaatttattacttgtcagtcaagttataattaacgttcggtacccttccgttactacgttttcggaccgtacggggaccaaggtcgtaggacgtaactacgaaacgtaacgtggtacggactcgaccacctacg

SEQ ID NO: 69180 - DNA, 482 bp, Homo sapiens
  misc_feature: GYAE6OF02H6TBI.51.76.G10.1.454.CMB.1.raw
  modified_base (474)..(474): a, c, t, g, unknown or other
  misc_feature (474)..(474): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggcctcccaggctcctcatctatgatgcatccacaagggccactgatatcccagccaggttcagtgcagtggtctgggacagagttcactctcaccatcagcagcctgcagtctgagtatttgactaatttattactgtcagtcagtataataactgcctcgtactactttggccagggaccagctaggagatcaacgactgtggntgcactac

SEQ ID NO: 69181 - DNA, 735 bp, Homo sapiens
  misc_feature: GYAE6OF02HG5DA.51.76.G10.1.454.CMB.1.raw
  modified_base (95)..(95): a, c, t, g, unknown or other
  misc_feature (95)..(95): n is a, c, g, or t
  modified_base (177)..(177): a, c, t, g, unknown or other
  misc_feature (177)..(177): n is a, c, g, or t
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
tcagcgatcgtatacacgaccggtgctcgatttagtcactcatacagggaggaactgctcagttaggacccagacggaaccatggaagcccccgngcagctctcttcctcctcgctactctgctcccacgatacacctgaggaagtagtgatgacgcagtctccagccaccctcgtntntgtctccagggaaagganccaccctcctcctcgcagggccgacgtcagagtgttagcagcggacttatccgcgtacgacacgaacgaaaccgtcggccgacggccgtcccacggctccctacatacttacgtgatagtcaacttccgaccaaaggggccacctgactaatccccacggccaggttcgangggtcgacttggggtcgtcgggaacaacgtaggtttcccactccttccgaacccaatcgtacgacgtacgaccccgtcgtaccgaagtaccttggaaacgtaattttttggtaacccttaatttttaaacgttttaacctaggtttacctaacggtcctaacggtttaaacgttaaactttaaaaccggtccgggttccccgtttaacccgtttaaccgtaaaccggttttttccggttacccggggaaacccgggggtacccggtaaaaccgtacggtttacggggtaaacggaaacttaccgtaaaaacccgggaaacgtttcgggtcggtaccggttacctacccggtaccctagtttacccgg

SEQ ID NO: 69182 - DNA, 504 bp, Homo sapiens
  misc_feature: GYAE6OF02I80OT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagacgttcacgtctcacatcagcagctagcagtctgaagtatttgactaatttatactgtcagtcagtataataactgtccttcgtactacgtttgacctagggacctaaggtctaggagtactacgaaacgtactggtacgctacgactacgtacg

SEQ ID NO: 69183 - DNA, 546 bp, Homo sapiens
  misc_feature: GYAE6OF02I76KO.51.76.G10.1.454.CMB.1.raw
  modified_base (196)..(196): a, c, t, g, unknown or other
  misc_feature (196)..(196): n is a, c, g, or t
  modified_base (317)..(317): a, c, t, g, unknown or other
  misc_feature (317)..(317): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatacnccagccaggttcagtgcagtggtctgggacagattcactctcaccatcagcagcctgcagtctagaagtatttgactaatttattactgtactagactagttaataaattaacgtacgtaccttaccgttaccttacgttttacggaccgtaggggacctaacggtcgttagggaagtaacgtacgtaaaacggtaacgttcggtacggtacgtacgacctacctaacg

SEQ ID NO: 69184 - DNA, 493 bp, Homo sapiens
  misc_feature: GYAE6OF02GISVF.51.76.G10.1.454.CMB.1.raw
  modified_base (195)..(195): a, c, t, g, unknown or other
  misc_feature (195)..(195): n is a, c, g, or t
  modified_base (393)..(393): a, c, t, g, unknown or other
  misc_feature (393)..(393): n is a, c, g, or t
  modified_base (468)..(468): a, c, t, g, unknown or other
  misc_feature (468)..(468): n is a, c, g, or t
  modified_base (482)..(482): a, c, t, g, unknown or other
  misc_feature (482)..(482): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccaacagaaacctggccaggctcccaggctcctcatctatgatgcatccacaagggccactgatactcccagccaggttcagtggcaggtgggtctgggacagagttcactctcaccatcagcacgcctgctagtctagaagtntttgactaatttattactgtcagtcagtataatactgtcctcgtactacgtttgccgtagggaccaagcgtgganactacgaacgatgnggctgcacatc

SEQ ID NO: 69185 - DNA, 478 bp, Homo sapiens
  misc_feature: GYAE6OF02HPRQ4.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagatttgcaatttattactgtcagcagtataataactgcctcgtacacttttgccagggaccaagctggagatcaaacgactgtggctgcactac

SEQ ID NO: 69186 - DNA, 540 bp, Homo sapiens
  misc_feature: GYAE6OF02GSSBT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccagttcagtggcagtggtctgggacagagttcactctcaccatcagcacgcctgcagtctagaagtatttgactaatttattactgtcagtactagttataataactacggtaccttaccgtacttacgttttcggaccgtacggggtacctaacggtcgtacggaagtacgtaacgaaacgtaacgtacggtacggtacgtacgtactaccgtacg

SEQ ID NO: 69187 - DNA, 495 bp, Homo sapiens
  misc_feature: GYAE6OF02G5NPQ.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtcagcagtataataactggcctccgtactactttggcctaggggaccaaggctggagtatacgaaacgaactgtggctcgcactacg

SEQ ID NO: 69188 - DNA, 483 bp, Homo sapiens
  misc_feature: GYAE6OF02FG14E.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtatttgctaatttattactgtcagcagtataatactgtcctcgtactctttgccagggaccagctggagatacgaacgacgtgtggctcgacactac

SEQ ID NO: 69189 - DNA, 534 bp, Homo sapiens
  misc_feature: GYAE6OF02G70JT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcaacttagcctggtaccagcagaacctggccaggctcccaggctcctcatctatgatgcatccacgaagggccactgatatcccagccaggttcagtggcaggtgggtctgggacagtagttcactctcaccatcagcagcctgcagtctagaagtatttgacttaatttattactgtctagctaagttataataacgtcggtaccttaccgttactaccgtttcggaccgtacggggacctaaggtcgtaggacgtacgtaccgaaacgtacgtcggtacggcgtacgaccacctacg

SEQ ID NO: 69190 - DNA, 491 bp, Homo sapiens
  misc_feature: GYAE6OF02IQGBK.51.76.G10.1.454.CMB.1.raw
  modified_base (350)..(350): a, c, t, g, unknown or other
  misc_feature (350)..(350): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacngagttcactctcaccatcagcagcctgcagtctgaagtatttgactaatttattactgtcagctagtataataacgtgcctaccgtactactttgcgagggaccaagctaggagatacgaacgactaggtggctgcactac

SEQ ID NO: 69191 - DNA, 500 bp, Homo sapiens
  misc_feature: GYAE6OF02GJ19F.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctagaagtatttgactaatttattactgtcagcagtataataactgtcctaccgtactacgtttcggaccgagggaccaaggtctaggacgatacaaacgacgtgtcggctcgacactac

SEQ ID NO: 69192 - DNA, 585 bp, Homo sapiens
  misc_feature: GYAE6OF02JZPF5.51.76.G10.1.454.CMB.1.raw
  modified_base (195)..(195): a, c, t, g, unknown or other
  misc_feature (195)..(195): n is a, c, g, or t
  modified_base (323)..(323): a, c, t, g, unknown or other
  misc_feature (323)..(323): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgagggaaangccacctctcctgcgagggccagtcagagtgttagcagcgacttagcctggtaccagcaagaacctggaccaggcctcccgaggtcctcctcatctatgatcgcatccgagaacggccactgactacncccagcctaggttcaggtcggactaggtcggtctagggactagtacgttccacgtctcacacgtcgacgcacgtctgcgtagtcgtagtaagtagtttgtactaagtttattacgtagtacgtagtcgtaagttactaacttaacgttacgtaccgttaccgtacgttacgttttacgaccgtacgggtaccgtaacggtcgtacggtacgtaacgtaccgtaaacgtacgttacggtacgtacgtcgtaccgtacgtaacg

SEQ ID NO: 69193 - DNA, 482 bp, Homo sapiens
  misc_feature: GYAE6OF02GYWU4.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtgcagtgggtctgggacagagttcactctcaccatcagcagcctgcagtctgaagattttgctatttattactgtcagcagtataatactggtcctcgtactactttggccagggaccaggcgtggagatacaacgactcgtggctgcactac

SEQ ID NO: 69194 - DNA, 481 bp, Homo sapiens
  misc_feature: GYAE6OF02GLY8U.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagattttgctaatttattactgtcagcagtataataactgcctcgtacactttgctagggaccagctaggagtatacgaagactgtggctgcactac

SEQ ID NO: 69195 - DNA, 497 bp, Homo sapiens
  misc_feature: GYAE6OF02G54WS.51.76.G10.1.454.CMB.1.raw
  modified_base (196)..(196): a, c, t, g, unknown or other
  misc_feature (196)..(196): n is a, c, g, or t
  modified_base (409)..(409): a, c, t, g, unknown or other
  misc_feature (409)..(409): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaaacctggccaggctccaggcctcctcatctatgatgcatccacaagggccactgatatcccagccaggttcagtggcagtgggtctgggacagagttcactctcacatcagcagcctgcagtctagaagtatttgactaatttattactntcagctagtataataactgaccttcgtactacgtttcgccgtacgggacacgtctggagtacgtacgaacgactagtggctgcactac

SEQ ID NO: 69196 - DNA, 494 bp, Homo sapiens
  misc_feature: GYAE6OF02JD0XQ.51.76.G10.1.454.CMB.1.raw
  modified_base (195)..(195): a, c, t, g, unknown or other
  misc_feature (195)..(195): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttagcagcgacttagcctggtaccagcagaaacctggccaggctcccaggctccnatctatgatgcatccacaagggccactgatatcccagccaggttcagtggcagtggtctgggacagagttcactctcacatcagcagcctgcagtctgaagtatttgactaatttattactgtctagactagtataataactgtacctacgtactactttagcctagggacagcgtagagatacgaacgacgtgtacgtcgtcgactactacg

SEQ ID NO: 69197 - DNA, 495 bp, Homo sapiens
  misc_feature: GYAE6OF02GX14E.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcagtggtctgggacagagttcactctcaccatcagcagcctgcagtctgaagtatttgactaatttattactgtcagtctagtataatacgtgtacctcgtactacgtttgccgtagggaccagtctaggagtatacgaacgtacgtgtgctgcactacg

SEQ ID NO: 69198 - DNA, 526 bp, Homo sapiens
  misc_feature: GYAE6OF02IJ0CH.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacgaagggccatgatactcccagccaggttcagtggcaggtgggtctgggacagagttcactctcacatcagcagcctgcagtctagtaagtatttgactaattttattactgtcagtctaagtaataataacgtcgtacctccgttactaccgttttcggaccgtaggggacctaaggcgtaggagtaactacgaaacgtacgtaggtaggactagaccacctacg

SEQ ID NO: 69199 - DNA, 491 bp, Homo sapiens
  misc_feature: GYAE6OF02FXKZ9.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtgggtctgggacagagttcactctcaccatcagcagcctgcagtctgaagtatttgactaatttattactgtacagcagtataataactgtcctccgtactactttcgccagggaccaagcgtaggagatacgaacgtactggtcgctgcactac

SEQ ID NO: 69200 - DNA, 495 bp, Homo sapiens
  misc_feature: GYAE6OF02HMSAV.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtatttgactaatttattactgtcagcagtataataatgacctccgtactactttcgccaggggaccaaggcgtaggagatacaaacgactggtaggctagcacctacg

SEQ ID NO: 69201 - DNA, 554 bp, Homo sapiens
  misc_feature: GYAE6OF02IR9CX.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcaggtgcaggtgggtctgggacagagttcactctcacatcagcacgcctgcagtctagaagtatttgacttaatttattactgtcagtctaagttaataataacgtcgtacccttccgttaactacgttttacggacccgtacggggaacctaacggtcgtaggaacgtaacgtaaccgaaaccggtaacgttacggtacggtacgtacggtacctaccgtaacg

SEQ ID NO: 69202 - DNA, 561 bp, Homo sapiens
  misc_feature: GYAE6OF02HCDQ5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttcagtggcaggtggtctgggacaggagttcactctcaccatcagcacgcctgcagtctagaagtatttgacttaattttattactgtctagctaagttataaattaacgtcggtacccttaccgttacttaccgttttgggacccgtacggggacctaacggtccgttagggaacgtaacgtaaccgtaaaccggtacgttacggtacggtaccgttacggacctacccgtacg

SEQ ID NO: 69203 - DNA, 493 bp, Homo sapiens
  misc_feature: GYAE6OF02JET0H.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcacatcagcagcctgcagtctagaagtattttgactaatttattactgtacagctagtataataactggtccttcgtactacgtttgccgtagggaccaaggctaggagatacgaacgactgtgctgcactac

SEQ ID NO: 69204 - DNA, 487 bp, Homo sapiens
  misc_feature: GYAE6OF02GJWKM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctgggacagagttcactctcaccatcagcagcctgcagtctgaagtatttgctaatttattactgtcagcagtataatactgcctcgtactactttgccgagggaccaagctaggacgatacaaacgactgtggctgacactac

SEQ ID NO: 69205 - DNA, 525 bp, Homo sapiens
  misc_feature: GYAE6OF02GGGN1.51.76.G10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttagcagcgacttagcctggtaccagcagaaacctggccaggctcccaggctcctcatctatgatgcatccacaagggccactgatactcccagcccaggttcagtggcaggtgggtctggggactaggtacgttccacttctacaccatccagcagcctgcagtctagaagtattttgcttaatttacttactgtacagtcagtataatacgtcgtccttccgtactacgtttcggaccgtagggacctaggtcgtaggagtactacgaacgtacgtggtacggctcgacctactacg

SEQ ID NO: 69206 - DNA, 533 bp, Homo sapiens
  misc_feature: GYAE6OF02GZTF3.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtgcagtggtctgggacagagttcactctcaccatcagcagcctgcagtctgagtattttgctaatttattactgtcagctaagttataagttaactggtcctaccgtactacgttttcggaccgtaggggtacctaacggcgttagggacgtaacgtaccgaaacgtaacgttcggtacggacgttggaccgtaccgtaacg

SEQ ID NO: 69207 - DNA, 534 bp, Homo sapiens
  misc_feature: GYAE6OF02JEQNR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggctcctcatctatgatgtatccagaacgggccactgatactccagccaggttcaggtggcaggtcgggtctggggacaggtagttcactctcaccatcagcagcctgcagtctagaagtatttgacttaatttacttactgtcagctagttataatacgtcggtaccttcgtactacgtttcggaccgacgggacaagtcgtaggaacgactaaccgaaacgtaacgtcggtacggtcctagacctaccgtattaccg

SEQ ID NO: 69208 - DNA, 492 bp, Homo sapiens
  misc_feature: GYAE6OF02ICUBR.51.76.G10.1.454.CMB.1.raw
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtcngggacagngttcactctcaccatcagcagcctgcagtctgaagtattttgactaatttattactgtcagcagtataataactggcctccgtactactttgccgagggaccaaggctggagtatacaaagacgtgtggctgccactacg

SEQ ID NO: 69209 - DNA, 504 bp, Homo sapiens
  misc_feature: GYAE6OF02JD2DJ.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatactcccagccaggttcagtggcaggtggtctgggacagagttcactctcacatcagcagcctgcagtctgaagtatttgacttaatttattacttgtcagctagtataataacgtcgtcctcgtacttacgttcgccgtagggaccagcgtaggagtacgtacaacgtacgtgtacggctcggcactacg

SEQ ID NO: 69210 - DNA, 563 bp, Homo sapiens
  misc_feature: GYAE6OF02JBGVJ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttagcagcgacttagcctggtaccagcagaaacctggccaggctcccaggctccgtcatctatgatgcatccacaagggccactgatactccagccaggttcagtgctaggtggtctgggacagacgttcgacgtctacgacatcagcacgcctgctagtctagtaagtagtttgacttaatttattacttagtactagtactaagttaataataacgtacgtacctacgttactacgttttacggaccgtacgggtaccgtaacggtcgtaggtacggtaacgttaaccgtaaacggaacgttacggtacggtaccgtacgtaccgtaccgtacg

SEQ ID NO: 69211 - DNA, 570 bp, Homo sapiens
  misc_feature: GYAE6OF02JWQC7.51.76.G10.1.454.CMB.1.raw
  modified_base (197)..(197): a, c, t, g, unknown or other
  misc_feature (197)..(197): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggcctcccaggctcctcatctagtgatcgcactccaacgaacgggccactgactactcccagccaggttcagtgctaggtcggtctggacagtacgtcactctcacatcagcagcctgcagtctagtagtntttacgacttaatttacttacgtgtactagtactagttaattaacgtaacgtcggtacccgttaccgttaacttacgttttacggacccgtacggggtaacctaacggtcgtacggacgtaacgtaccgtaaacgtacgttacggtacggtacgtacggacctaccgtacg

SEQ ID NO: 69212 - DNA, 799 bp, Homo sapiens
  misc_feature: GYAE6OF02GT2ZR.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagttgatgaacgtcacgtctcccacgtccaccctgtctcgtcgtacggtccaggggaagcgacccaccctctccgtgcgacgggccagtcggagtacgtgttacgcagacgtacttacgccgtacggtaacccaggacacgtaaaccgtcggaccgtacggcgtccccaggcctccgtctatctagtagactcgtccacgtcccaacgtacggggcctaccgtaggacctacgttaccccaaggcccgtacgggtttcgacggttcggggcgaagggttcgggttcctacggggtacctaacggtaaccgttccaacctcccgtaccgacccgtacgttaccgacggtaccgtaacggtcccgttaacggaccgttaacggttcccttaaggttaaacgtttacgtttttacggtacttaaagttttaccgttaaccgttagttacctaaagttaccgttaacggttaaccgtttaaaccgttaaccggttaccgggttacccggttacccgttaaaccggttaaccgttttaccggggacccggtacggggtaaccctaacgggtaccgttacgggtaacgtaacgttaacccggtaaaccggtaccgttcgggttaccggtaccttacggtaccctaaccgtttacccg

SEQ ID NO: 69213 - DNA, 507 bp, Homo sapiens
  misc_feature: GYAE6OF02HVNUA.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcaagaaacctggccaggctcccaggctcctcatctatgatgcatccacaagggccactgatatcccagccaggttcagtggcaggtggtctgggacagtagttcactctcaccatcagcagcctgcagtctgaagtattttgataattttatactgtcagacagtaataataactcggtccttccgtactacgtttcggccgtacgggaccgaagcgtaggagacttacgaacgactgtggtactcgcactac

SEQ ID NO: 69214 - DNA, 490 bp, Homo sapiens
  misc_feature: GYAE6OF02IXQ8O.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctagaagtattttgactaatttattactgtcagcagtataataacgtgcctcgtactactttgccagggaccagcgtaggagaatacaacgaactgtaggctgacaccta

SEQ ID NO: 69215 - DNA, 579 bp, Homo sapiens
  misc_feature: GYAE6OF02F66WV.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcactccacgaacgggccacgtgatactcccagccaggttcagtggcaggtgggtctgggacaggacgttccacttcctaccacctatcacgcacgcctgcagtctagaagtatttagacttaattttacttacttgtactagtactaagttaattaaacgttaacgtacggtaccgttaccgtacgttacgttttaccgggaccgtacggggtacctaacggtcgtaggtaacggtaacgtaccgaaacgtacgttacggtacggtacgtacggacctaccgtacg

SEQ ID NO: 69216 - DNA, 510 bp, Homo sapiens
  misc_feature: GYAE6OF02JUPDB.51.76.G10.1.454.CMB.1.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
  modified_base (475)..(475): a, c, t, g, unknown or other
  misc_feature (475)..(475): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaaggccactgatactccagccaggttcagtgcaggtggtctgggacagtagttcactcgtcaccatcagcagcctgcagtctagaagtntttgactaatttacttctagtcagtctagtataataacgtgtccttcgtactacgtttcggacctaggggtaccaggtcgtaggngtaactacgaacgtacgtgtgcgtagtcgacctag

SEQ ID NO: 69217 - DNA, 520 bp, Homo sapiens
  misc_feature: GYAE6OF02G3LT0.51.76.G10.1.454.CMB.1.raw
  modified_base (195)..(195): a, c, t, g, unknown or other
  misc_feature (195)..(195): n is a, c, g, or t
  modified_base (350)..(350): a, c, t, g, unknown or other
  misc_feature (350)..(350): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacgaggccactgactactcccagccaggttcagtgcagtgggtctgggacagngttcactctcacatcagcacgcctgcagtctagagtatttgacttaatttattacttgtacagtactagttataataactggtaccttacgtactacgtttcggaccgtagggaccaggtcgtaggacgtataacgaaacgtacgttggtacggctacgacctacctacg

SEQ ID NO: 69218 - DNA, 485 bp, Homo sapiens
  misc_feature: GYAE6OF02F3XCN.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcaggtctccagccaccctgtctgtgtctccaggggaaangccaccctctcctgcagggccagtcagagtgttagcagcgacttagccctggtaccagcagaaacctggccaggctcccaggctcctcatctatgatgcatccacaagggccatgatatcccagccaggttcagtggcagtgggtctgggacagagttcactctcaccatcagcagcctgcagtctgaagtattttgctaatttattactgtcagcagtataataactgcctcgtactactttggcctagggaccaagctggagatacaaacgactgtggctgcactac

SEQ ID NO: 69219 - DNA, 493 bp, Homo sapiens
  misc_feature: GYAE6OF02GW9W1.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcaggtggtctgggacagagttcactctcaccatcagcagcctgcattctgaagtatttgctaatttattactgtacagcagtataatactgaccttcgtactactttgcctagggaccaaggtctaggagatacgaacgaacgtgtaggctagcactacg

SEQ ID NO: 69220 - DNA, 513 bp, Homo sapiens
  misc_feature: GYAE6OF02I6IVN.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcacatcagcagcctgcagtctgaagtatttgactaatttattactgtcagctagtataataactgccttacgtactactttcggaccgtaggggaccaaggtctagggacgtatacgaaacggtaacgtggtacggactacgacctactacg

SEQ ID NO: 69221 - DNA, 911 bp, Homo sapiens
  misc_feature: GYAE6OF02FVZG5.51.76.G10.1.454.CMB.1.raw
  modified_base (219)..(219): a, c, t, g, unknown or other
  misc_feature (219)..(219): n is a, c, g, or t
tcagcgatcgtatacacgaccggtgctcgatttagtcactcatacaggggagaactaggcctaacagttacggaccctaggacggaaccactggaagccccagcgcacgcttcctcttccgtccgtcgcgtactctggcctttccctaggataccactggagaagtagtggatcgacgccaggttctccaggccaccctgtctgtgtctcgaggggaangccacctctcctggccagggccagtcaggagttcgttagcaggtcgactttagccgttaggtacctagttccacgtaaacccgttggaccaaggtcgttccccgagggccttacccgtccccgagttaccggtacttcggaagttggactaggtaccgtaacgaacggggtcccaacgtcggtaacgtaacttaacccaaggtacccgtaacggtttacgaggtagggacgtacggtacggggtacgttaggggactacggggggatttaccgaacgttccgtaccgacccgtaacttaccgaacgtcccgaacggtacccgttacggaccgtaacggttaccttacggtaaacggttaacgttttttacgggaaccgtttaaacgtttttaaccgttttaaccgtttacgggttttaccgttaacggttaccgtaaacgggtttaaaccgttaaaacggtttaaacccggtttacgggttaaccccgttttaacccggtttaaacccgttaacccggtttttttaccggggtaacccgggttaacggggggtaaccccgttaaacgggttcccggttaacggggttaaaccggttaaccggtttaacccggtaaaaccgggttaacccgtttacgggtttaacccgggttaccggttaccgggttacccggttaacccggtttaacccggg

SEQ ID NO: 69222 - DNA, 537 bp, Homo sapiens
  misc_feature: GYAE6OF02I61P1.51.76.G10.1.454.CMB.1.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttcagtggcagtgggtctgggacagacttcactctcaccatcagcagcctgctagtctagagtntttagactaatttacttactgtcagtctagttataactaacgtcggtacccttaccgtacttacgtttcggaccgtacgggtacctaaggtcgtaggaacgtacgttacgaaacgtacgttcggtacggcgtacgtacctacgtacg

SEQ ID NO: 69223 - DNA, 485 bp, Homo sapiens
  misc_feature: GYAE6OF02F9C9D.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatccagccaggttcagtggcagtgggtctgggacagagttcactctcaccatcagcagcctgcagtctgaagtattttgctaatttattactgtcagcagtataataactggcctcgtactactttgccagggaccaaggctaggagatacaacgactgtggctgcactac

SEQ ID NO: 69224 - DNA, 485 bp, Homo sapiens
  misc_feature: GYAE6OF02FTNDM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcacatcagcagcctgcagtctgaagtattttgactaatttattactgtcagcagtataataactgtacctccgtactacgtttgcctagggaccagctggagatacaagactgtagctgcactac

SEQ ID NO: 69225 - DNA, 536 bp, Homo sapiens
  misc_feature: GYAE6OF02F9ZU9.51.76.G10.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcagaacctggccaggctcccaggctcctcatctatgatgcatccanaacgggccatgatactcccagcctaggttcagtggcaggtggtctgggacngtagttcactctcaccatcagcagcctgctagtctagaagtatttgacttaatttattactgtacagtactagtataataacgtcgtaccttaccgtactacgtttcggaccgtacgggacctaacggtcgtaggacgtaacgtaaccgtaaacgtacgtacggtacggtctacgtaccacctacg

SEQ ID NO: 69226 - DNA, 626 bp, Homo sapiens
  misc_feature: GYAE6OF02HX8PI.51.76.G10.1.454.CMB.1.raw
tcagcgatcgtatacacgaccggtgctcgatttagtcactcatacagggggaggaactgcctttttttttttttttttttttttttttttttagaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggcctcccaggcctcctcatctatgatgcactccacgaacgggccaagtgaatactcccgagcctaggttccaggtcggctagggttgggtctaggggactaggtacgttcacttctaccaacctatccacgcacgcctgctagtctagtaagttattttgacttaaattttattactgtacagtactaagttaataataacgtcgtacccttaccgttacgtacgttttacgggaccgtacggggtaaccctaaggtcggtacgggaacgtaacgttaaccgaaaaccggttaacgttacggtacggtaccgtacgacctaccgtacg

SEQ ID NO: 69227 - DNA, 647 bp, Homo sapiens
  misc_feature: GYAE6OF02H8EMX.51.76.G10.1.454.CMB.1.raw
  modified_base (196)..(196): a, c, t, g, unknown or other
  misc_feature (196)..(196): n is a, c, g, or t
  modified_base (417)..(417): a, c, t, g, unknown or other
  misc_feature (417)..(417): n is a, c, g, or t
tcagcgatcgtatacacgaccggtgctcgatttagtcactcatacaggggaggaacgtgctcagttaggaccagacggaaccatggaagcccagcgcagcttctcttcctctgctactctggctcccagataccactggagaagtagtgatgacgcagtctccagccaccctgtctgtcgtctaccgaggggaaanacgcccacccttctcctgcgagggccaacgttcagagttgttagcagccgaattacgccgttggtaccagcaacggaaacctgggccaggctccccgaggcctctccatctatcgatgcatccacgaacgggccaactgactatcccaaggcaaggtttccaaggtcggcaggttggtccgagggaccagtagttccgaaccttcgtcaccgtatccgaanccgagccctggaccctggtacctggtaaacgtgtttttaagcctaaatttttaccttaacggttatacctaaggtacctaaggttaaactaaacttaacgttacgggtacccttaccggttaactaaccgtttttaccggtccgaacggggttaccaacggtcgttaccggaggtaaccgtttacgaaacggttaacctgggtaccggtaacgtcgtaccgtaaccctag

SEQ ID NO: 69228 - DNA, 530 bp, Homo sapiens
  misc_feature: GYAE6OF02HBL5V.51.76.G10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (323)..(323): a, c, t, g, unknown or other
  misc_feature (323)..(323): n is a, c, g, or t
  modified_base (410)..(410): a, c, t, g, unknown or other
  misc_feature (410)..(410): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacagggggaggaactgctcagttaggacccagacgggaaccgatggaagccccagcgccagcttctcttcctcctgctactctggctcccagataccactggagaagtagtgatgacgcagtctccagccaccctgtctgtgtctcaggggaaangccaccctntcctgcagggccagtcagagtgttagcagcgacttagcctggtaccagcagaaacctggccaggcctcccaggcctcctacatctagtgatgcatccacgaagggccactgatacncccgagccaggttcagtgctaggtggtactgggacagtacgttcactctacaccatcagcagcctgctagtcgtagaagtagttttnacttaattttaattatgttcagntagttaataataacgtcgtcctcgtactacgttttcggaccgtacgggacaacggtcgtaggagtataacgaacgtaacgtgtggactcgacactac

SEQ ID NO: 69229 - DNA, 534 bp, Homo sapiens
  misc_feature: GYAE6OF02I6SM9.51.76.G10.1.454.CMB.1.raw
  modified_base (257)..(257): a, c, t, g, unknown or other
  misc_feature (257)..(257): n is a, c, g, or t
tcagcgatcgtatacacgaccggtgctcgatttagtcactcatacaggggagggaactgctcagttacggacccagacggaaccatggaagccccagcgcagcttctcttcctcctgctactctggctcccagataccactggagaagtagtgatgtacgcagtctccagccaccctgtctgtgtctccaggggaaagagccaccctcgtcctgccagggcccaggtccagagtgttagcagcgacttagcctggtnccagcagaacctgaccaggctccaggcctccgtcatctatgagtggcatccgacgaacgggccagttgatacgtcccagtccaggttcagtggcaggtcggtctcggggacaggacgtttcaccttctaccacctactccagcagcctgacagtctagtacttatttgactaatttatactcgtcagcagtataactacgtcgccttaccgttactacgtttgcgtacgggaccagtctaggagtagtacgaacgtacgtgaggtcgtacgctaccg

SEQ ID NO: 69230 - DNA, 533 bp, Homo sapiens
  misc_feature: GYAE6OF02H6FNG.51.76.G10.1.454.CMB.1.raw
  modified_base (196)..(196): a, c, t, g, unknown or other
  misc_feature (196)..(196): n is a, c, g, or t
  modified_base (354)..(354): a, c, t, g, unknown or other
  misc_feature (354)..(354): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctgggacagngttcactctcacatcagcacgcctgcagtctagaagtattttgacttaattttattactgtactagtcaagttataatagtcgtccttaccgtactacgtttcggaccgtacggggtacctaaggtcgtaggtacgtactaccgaaacgtacgtaggtacggtctacggtaccactacg

SEQ ID NO: 69231 - DNA, 592 bp, Homo sapiens
  misc_feature: GYAE6OF02JJ5PC.51.76.G10.1.454.CMB.1.raw
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (250)..(250): a, c, t, g, unknown or other
  misc_feature (250)..(250): n is a, c, g, or t
  modified_base (266)..(266): a, c, t, g, unknown or other
  misc_feature (266)..(266): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccacctntcctgcagggccagtcagagtgtagcagcgacttgcctgtaccagcngaaacctggccgtacnggctccgagctcctcatctatcgatcgacagtaccgacgaacggccaacgtcgactacgtacccgaagtaccagggttccaggtcggtacgtacggtcgggtactaggggtaactaggtacgttcgactctactaccactacgaacgtcacgcctagacgtagtactagtaacgtactttagtacttaagtttactactagtactagtactagtaactaacgttacgttacgtaccttaccgttactacgtttacggaccgtacgggtacctaaggctaggaacgtaacgtacgtaacgtacgtacggtacgtacgtacgactacg

SEQ ID NO: 69232 - DNA, 508 bp, Homo sapiens
  misc_feature: GYAE6OF02GCV8Y.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcaggtggtctgggacagagttcactctcacatcagcagcctgcagtctgaagtatttgacttaatttattacttgtcagtctagtataataactgtacctccgtactacgtttcgaccgtacgggaccaagtcgtaggagacgtacgaacgtacgtgtacgactacgtacactac

SEQ ID NO: 69233 - DNA, 532 bp, Homo sapiens
  misc_feature: GYAE6OF02G163W.51.76.G10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctnatctatgatgcatccacgaagggccatgatactcccagccaggttcagtggacaggtggtctgggacaggacgttcactctacaccatcacgcacgcctgcagtctagaagtatttgactaagtttattactgtcagtctaagtataactacgtcgtccttaccgtactacgtttcgaccgtacgggacctaggtcgtaggaacgtacgtacgaacgtacgtggtacggtactcggtaccaccgtacg

SEQ ID NO: 69234 - DNA, 508 bp, Homo sapiens
  misc_feature: GYAE6OF02G4HU3.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcagtgggtctgggacagtagttcactctcaccatcagcagcctgcagtctagtaagtattttgactaatttattacttgtacagtctaagtataataactcggtcctaccgtactacgtttcggccgtagggaccaggtcgtaggagtactacaacgactgtagctgcactac

SEQ ID NO: 69235 - DNA, 489 bp, Homo sapiens
  misc_feature: GYAE6OF02IVTW1.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagagccaccctctcctgcagggccagtcagagtgttagcagcgacttagcctggtaccagcagaaacctggccaggctcccaggctcctcatctatgatgcatccacaagggccatgatatcccagccaggttcagtggcagtgggtctgggacagagtcactctcaccatcagcagcctgcagtctgaagtattttgcttaatttattactgtacagcagtataataacgtgtcctcgtactactttgccagggaccagctaggagatacgaacgacgtcgtagctgacactac

SEQ ID NO: 69236 - DNA, 510 bp, Homo sapiens
  misc_feature: GYAE6OF02HGR1C.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagagtgttagcagcgacttagcctggtaccagcagaaacctggccaggctccaggctcctcatctatgatgcatccacaagggccactgatatcccagccagttcagtggcagtggtctgggacagagttcactctcaccatcagcagcctgcagtctgaagtatttgactaatttattactgtcagtctagtataataactgtccttaccgtactacgtttcggaccgtagggtaccaacggtcgtaggagaatacgaaacgtactcggtagtacgtcgacacctacg

SEQ ID NO: 69237 - DNA, 502 bp, Homo sapiens
  misc_feature: GYAE6OF02GCPUH.51.76.G10.1.454.CMB.1.raw
  modified_base (196)..(196): a, c, t, g, unknown or other
  misc_feature (196)..(196): n is a, c, g, or t
  modified_base (299)..(299): a, c, t, g, unknown or other
  misc_feature (299)..(299): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctccaggctcctcatctatgatgcatccanaagggccatgatactcccagccaggttcagtggcaggtggtctgggacagagttcactctcaccatcagcagcctgcagtctagagtatttgacttaatttatacttgtacagctagtataataacgtgtcctaccgtactacgtttcggcctagggacctagtcgtagagactacgaacgtacgtcgtagctcgtacactac

SEQ ID NO: 69238 - DNA, 832 bp, Homo sapiens
  misc_feature: GYAE6OF02IA51U.51.76.G10.1.454.CMB.1.raw
  modified_base (304)..(304): a, c, t, g, unknown or other
  misc_feature (304)..(304): n is a, c, g, or t
tcagcgatcgtatacacgaccggtgctcgattttagtcactcatacagggggagggaactcgctccaggttaggacccagacggaacctatggaagccccagcgcagcttctcttcctcctgctactctggctccaggattaccgactggagaagttaggttgtatgacgtactaaggtctccagccacctgtctgtgtctccgaggggaaagacggtcaccttctcctgcaggggccagtcagagtgttagcagcgacttagctggtaccagtcaagaaacctggccaggctcccaggctccncatcctatggagtgacagttccgacgaacgggcctaacgttagaattacgtacccgaggtccgtaaggttccaggttacgggacctaagggtttcggggtaccgtacggggtaccgtaaggtaacgggttttcccaacctttaccgttaaccccgaacccgttaacttacccgaaacgggacccgaaacggaaccccgttacgaaaccgtaaccggttaccctaagggttaaaccggtttaacttttttttaaccctaaaagttttttaaactttaaaccgtttggtttaacccgaaaggttaccgttaaaggtttaaaacgttaaaacgttaaacccgttcggggtaaccccctttaaacccgggtttaaccgtttaaccggtttttaccgggtaacccggttaaacgggggtaaccctaaacgggtccggttaaacggggaacggtaaacgtaaccgtaaaaaccggtaaccgtttacgggtaaccgggtaccttaccgggacccgttaacccgtagtttacccgg

SEQ ID NO: 69239 - DNA, 498 bp, Homo sapiens
  misc_feature: GYAE6OF02GVNVQ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgagtatttgactaatttattactgtcagcagtatataactgtcctccgtactactttcggccgtagggaccaggcgtaggagagtaccgaacgtactggtacgcgtcgctactacg

SEQ ID NO: 69240 - DNA, 511 bp, Homo sapiens
  misc_feature: GYAE6OF02ICUL2.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctgggacagagttcactctcaccatcagcagcctgcagtctgaagtattttgactaatttattactgtcagtctagtataataacgtcgtaccttaccgtactacgtttcggaccgtacgggaccagcgtaggagtatacgaaacgtacgtggtcggctcgccacctac

SEQ ID NO: 69241 - DNA, 500 bp, Homo sapiens
  misc_feature: GYAE6OF02IXJ2L.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatcatgatgcatccacaagggccactgatatcccagcccaggttcagtggctaggtgggtctgggacagagttcactctcacactcagcagcctgcagtctagaagtatttgtactaatttattactgtcagctagtataataactgtcctcgtactacgtttgccgtagggacctaaggcgtggagacgtacaaacgtactcggtgctagcactac

SEQ ID NO: 69242 - DNA, 558 bp, Homo sapiens
  misc_feature: GYAE6OF02HRYBC.51.76.G10.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggctcccaggcctcctcatctatgatgcatccacgaagggccactgactactcccagcctaggttcagtggcaggtgggtctgggacaggtagttcacttcncaccatcagtcacgcctgcacgtctagtaagtatttgacttaatttacttactgtactagtactagttataagtaacgttacggtaccttaccgttacttacgttttacggaccgtacgggaccgtaacggtcgtacggtagtacgtaacgtaacgtaacgtcggtacggtcgtacgtacctacgtacg

SEQ ID NO: 69243 - DNA, 500 bp, Homo sapiens
  misc_feature: GYAE6OF02JEUHI.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaacgggccactgatactcccagccaggttcagtggcagtgggtctgggacagagttcactctcaccatcagcagcctgcagtctgaagtatttgctaatttattactgtcagctagtataataacgtgtcctccgtactactttgaccgagggaccagtcgtaggagatacgaaacgactggtacgcgtcgcacctacg

SEQ ID NO: 69244 - DNA, 523 bp, Homo sapiens
  misc_feature: GYAE6OF02HZBUO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacgaagggccactgactatcccagccaggttcagtggcagtgggtctgggacagagttcactctcacatcagcagcctgcagtctgagtatttgactaatttattactgtcagtcagtataataacgtcggtacctccgtactacgttttcggaccgtaggggtaccaaggtctagggacgtacgtacgaaacgtactcggtacggtcgtacggacctactacg

SEQ ID NO: 69245 - DNA, 501 bp, Homo sapiens
  misc_feature: GYAE6OF02GKHOL.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatacctccagccaggttcagtggcaggtgggtctgggacagagttcactctcaccatcagcagcctgcagtctagaagtatttgctaatttattacttgtcagctagtataataactcgtaccttccgtactactttggccgagggaccaaggcgtaggagatacgaacgactggtcggctcgcactac

SEQ ID NO: 69246 - DNA, 525 bp, Homo sapiens
  misc_feature: GYAE6OF02GU64Q.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggcctcccaggcctcctcatctatgatgcatccacgaaggcccactgatactcccagccaggttcagtggctaggtgggtctgggacagtacttcactctcaccatcagcagcctgcagtctagaagtatttgacttaatttattactgtacagtactagtataataacgtgtaccttccgtactacgtttacggcgtacgggacctaaggcgtaggacgtacgtacgaacgtacgtggtcggacgtcgtaccactacg

SEQ ID NO: 69247 - DNA, 528 bp, Homo sapiens
  misc_feature: GYAE6OF02F8V1D.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctgggacagagttcactctcaccatcagcacgcctgcagtctgaagtatttgtacttaatttattacttgtcagtctaagttaataataactcggtccgttaccgttactacgttttcggaccgtacggggaccaaggtcgtaggagtactacgtaaacgtacgtaggtggactcgcacctacg

SEQ ID NO: 69248 - DNA, 619 bp, Homo sapiens
  misc_feature: GYAE6OF02G8EA9.51.76.G10.1.454.CMB.1.raw
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggcccncgacgcctccnctactatgtgatcgactactaccgaacggacggcctacgtagtactacctaccgacgtaccgttacggtacgtaggtcgacgtagggttcgggtacggtacgggaacgtaggttacgtacctaccgttcctaccgtaacctactacgacgtacgaccgtccgtcgacgtacgtacgtaagtaacgtttagtttacgtaacttttaagttttacttacgttcgtacgacgtactaagttaattaacgttacgtacgtacccgttacgtacgttacgttcggacggtacggacacggtcgtagagtactaacgaagtacgtgcgtgtacgccatcg

SEQ ID NO: 69249 - DNA, 529 bp, Homo sapiens
  misc_feature: GYAE6OF02JIBJT.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccgaggctcctcatctatgatgcatccacaagggccactgactactccagcctaggtcagtggcagtgggtctgggacagtagttcactctcacatcagcagcctgcagtctagtaagtatttgactaattttatactgtacagactagtataaagtactacgtacctaccgtactacgttttgaccgtacgggtacctaacggtcgtaggagtaactaaccgaaacgtacgttacggtagccgtacggccaccgtac

SEQ ID NO: 69250 - DNA, 501 bp, Homo sapiens
  misc_feature: GYAE6OF02H1OA3.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaagagccaccctctcctgcagggccagtcagagtgttagcagcgacttagcctggtaccagcagaaacctggccaggctcccaggctcctcatctatgatgcatccacaagggccactgatactcccagccaggttcagtggcaggtgggtctgggacagtagttcactctcacatcagcagcctgcagtctagaagtattttgactaatttattactgtacagcagttataataactggccttccgtactactttcggaccgtagggaccaggtctggagtactacaacgactggtggctgacactac

SEQ ID NO: 69251 - DNA, 688 bp, Homo sapiens
  misc_feature: GYAE6OF02G11XF.51.76.G10.1.454.CMB.1.raw
tcagcgatcgtatacacgaccggtgctcgatttagtcactcatacagggggaggaacgtgcctcagttaggacccaagacgggaaccgattcggaagtccccgagcgcagcttctcttacctcctgcgtactctcggcttcccgagtagtaccactaggaggttaacgtagttgattgttaacgcgtagtcctccagccaacctgtctagtgtctccagggaaggagccacctctcctcgcgagggccagtcagagtcgttacgctagcgaacttacgccttgggttaccacgtccaagtaaacctggaccaggctcccgaggcctccgtcactactactgataggctagtaccgacggaacgggccaacgttgtactactcccgaggccgaggttcagttcggacgtaggttggtcgtgggacaggtacgttcgaacgtcctactaccactacacgtccaacgcccgtacgacctacgtacgtaacgaacgttaagttttacgtactttaaagtttactttaacgtacgtacacgtacgtaacgttaataaacgtaaccgtcggtaccttaccgttaaccttacgttttacggaacccggtaggggtaaccggtaacgtcggtagggtaacgtacgtaaccgtaaacgttaccgttaggttaccggcgttacggaccgtaccgtacg

SEQ ID NO: 69252 - DNA, 552 bp, Homo sapiens
  misc_feature: GYAE6OF02IFVMO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggctcctcatctatgatgcatccacgaacgggccactgatactccagccaggttcagtggcaggtgggtctgggacagagttcactcgtcaccatcagcagcctgcagtctagaagtatttgacttaatttattacttgtactagactaagttataacttaacgtcgtaccgttacccgttaacttaccgttttacggaccgtacggggacctaacggtcgttacggagtacgtaaccgaaacgtacgtaggtacggacgtacgtactaccgtacg

SEQ ID NO: 69253 - DNA, 550 bp, Homo sapiens
  misc_feature: GYAE6OF02IPZH7.51.76.G10.1.454.CMB.1.raw
  modified_base (196)..(196): a, c, t, g, unknown or other
  misc_feature (196)..(196): n is a, c, g, or t
  modified_base (351)..(351): a, c, t, g, unknown or other
  misc_feature (351)..(351): n is a, c, g, or t
  modified_base (401)..(401): a, c, t, g, unknown or other
  misc_feature (401)..(401): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggcctcccaggctcctcatctatgatgcatccacaacgggccactgatactcccagccaggttcagtgcagtggtctgggacngtagtcactctcacatcagcagcctgcagtctgaatatttgactaatttnttactgtctagctaatataataactcggccttaccgtacttacgtttcggaccgtacggggaacctacggtcgtacgggtaacgtaacgttaaccgtaaaaccggtaccgttacgggttacggtaccttacggacccgtaccgttaacg

SEQ ID NO: 69254 - DNA, 583 bp, Homo sapiens
  misc_feature: GYAE6OF02J0OC5.51.76.G10.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccngcagaacctggccaggctcccaggctcctcatctatgatgcactccacgaacgggccactgatactcccaagccctaggttccaggtggctaggtcgggtctgggacagtacgttcacgtctacaccatccagccacgtcctgccagttctaggtaagttagtttacgacttaagttttacttacgtgtactaaggactaagttaattaacttaaccgtcggtaccttaccgttaactaccgttttacgggacccgtaggggtaacccaaggtccttagggactaacgtaccgaaacgtacgtaggtcggtacgtacgtacctaccgtacg

SEQ ID NO: 69255 - DNA, 506 bp, Homo sapiens
  misc_feature: GYAE6OF02I7XK7.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgtagcagcgacttagcctggtaccagcagaacctggccaggctcccaggctcctcatctatgatgcatccacaagggccactgactatcccagccaggttcagtgcaggtggtctgggacagagttcactctacacatcagcacgcctgcagtctgaagtatttgactaattttattactgtcagctagttaataatactcggccttacgtacttacgtttcggaccgtagggacctaaggctaggacatacgaaacgtactggtcggctcgcactac

SEQ ID NO: 69256 - DNA, 509 bp, Homo sapiens
  misc_feature: GYAE6OF02FQCKX.51.76.G10.1.454.CMB.1.raw
  modified_base (196)..(196): a, c, t, g, unknown or other
  misc_feature (196)..(196): n is a, c, g, or t
  modified_base (360)..(360): a, c, t, g, unknown or other
  misc_feature (360)..(360): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccatgatatcccagccaggttcagtggcagtgggtctgggacagagttcactcncaccatcagcagcctgcagtctagaagtatttgacttaatttattactgtcagcagtataataacgtcgtcctacgtactacgtttcggaccgtaggggaccaggtcgtaggacgtactacgaaacgacgtggtggactgaccacgtac

SEQ ID NO: 69257 - DNA, 530 bp, Homo sapiens
  misc_feature: GYAE6OF02I14E1.51.76.G10.1.454.CMB.1.raw
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggcctcctcatctatgatgcatccacaagggccactgatntcccagccaggttcagtggcaggtgggtctgggacagagttcactctcacatcagcagcctgcagtctgaagtattttgacttaatttattactgtcagtctaagttataataacgtcggtacccttaccgtacttacgtttcggaccgtacggggtacctaaggtctaggagtaactacgaaacgtacgtggtacggtcgtacgacacctacg

SEQ ID NO: 69258 - DNA, 490 bp, Homo sapiens
  misc_feature: GYAE6OF02FYD61.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctcatctatgatgcatccacaagggccactgatatcccagccaggttcagtgcagtggtctgggacagagttcactctcaccatcagcagcctgcagtctgaagtatttgctaatttattactgtcagtcagtataataactgtcctaccgtactacgtttgccgtagggaccagtctaggagagtacaacgacgtagtgtctgcactacg

SEQ ID NO: 69259 - DNA, 501 bp, Homo sapiens
  misc_feature: GYAE6OF02FUI0U.51.76.G10.1.454.CMB.1.raw
  modified_base (196)..(196): a, c, t, g, unknown or other
  misc_feature (196)..(196): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccaacgaagggccactgatatcccagccaggttcagtggcaggtgggtctgggacagngttcactctcacatcagcagcctgcagtctgaagtatttgactaatttattactgtacagtcagttataatactgtcctccgtactacgtttgaccgtagggaccaggtctaggagtatacgaacgtacgtgtggctcgcactacg

SEQ ID NO: 69260 - DNA, 522 bp, Homo sapiens
  misc_feature: GYAE6OF02HRCDP.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcaggtggtctgggacagagttcactctcaccatcagcagcctgcagtctgaagtatttgactaattttattactgtcagactagtataataactgtaccttaccgtactacgttttggacctagacggtaaccgaaggtcgtagggaagtacgtacgaaacgtaacgtaggtacggactcgctaaccg

SEQ ID NO: 69261 - DNA, 578 bp, Homo sapiens
  misc_feature: GYAE6OF02HQXZO.51.76.G10.1.454.CMB.1.raw
  modified_base (198)..(198): a, c, t, g, unknown or other
  misc_feature (198)..(198): n is a, c, g, or t
  modified_base (414)..(414): a, c, t, g, unknown or other
  misc_feature (414)..(414): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgccaccctctcctgcagggccagtcagagtgttagcagcgacttagcctggtaccagcaacgaaacctggccaggcctcccgaggcctcctcactctatgatgacatccacgaacgggccagtgatactcccagcctaggttcaggtcggcgtaggtgggtcgtagggacaggtacgttcacctctcaccatcagcacgctgcagtctagtaatntttcgacttaattttacttacgtgtactagtactaagttataaacgtacgttccgtaccctttccgtaacttaccggtttacgggacccgtacggggaacctacggacgttaggagtaaccgtaacgtaaacggtacgtgggtcgtacgtcgtaccgacttacg

SEQ ID NO: 69262 - DNA, 561 bp, Homo sapiens
  misc_feature: GYAE6OF02IJDY0.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgattagcctggtaccagcagaaacctggccaggctcccaggctcctcatctatgatgcatccacaagggccactgatactcccagccaggttcagtggcaggtgggtctgggacagagttcactctcacatcagcagcctgcagtctagaagtatttgactaattttattactgtactagctaagttaataaattaacgtcggtacccttccgttaactaccgttttcggacccgtaacggggtaaccctaaggtacctagggaacgtaacgttaaccgaaaacggtaccgtaggttacggtacgttacggtacctaaccgtacg

SEQ ID NO: 69263 - DNA, 489 bp, Homo sapiens
  misc_feature: GYAE6OF02GF8XD.51.76.G10.1.454.CMB.1.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctggaacngagttcactctcaccatcagcagcctgcagtctagagtatttgactaatttattactgtacagtcagtataatactgtacctcgtactacgtttcgcgtagggaccagctaggagagtacaacgactgtgctcgacactac

SEQ ID NO: 69264 - DNA, 594 bp, Homo sapiens
  misc_feature: GYAE6OF02IKXDB.51.76.G10.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (401)..(401): a, c, t, g, unknown or other
  misc_feature (401)..(401): n is a, c, g, or t
tcagcgatcgtatacacgaccggtgctcgatttagtcactcatactaggggggtagggaactgctcagttaggacccagacggaaccgatggaagccccagcgcagcttctcttcctcctgctactctggctcccagataccactggagaagttgtgatgacgctagtcctccagcctaccctgtctgtgtctccgaggggaangcccaccctctcctgcagggccaggtccagagtgttagcagcgacttagcctgtaccagcagaaacctggaccaggcctcccgaggcctccctcatcctatgatcgctactccacgaagggccacgtgatactcccagccaggttcagtggcgtaggtggtcngggactagtattcactctcaccatacacncgacncctagcacgtcttagtagtattttcgacttaagttttacttaacttcgtacgtacgtactaaggttactttaaacgtaaccgttcgtaccctttaccggttaccgttaacgttttacgggacccgtaaggggaccgtaaggtcgtacggacgtaacgtacgtaaacgtacgtcgtagctacgtcctactaccg

SEQ ID NO: 69265 - DNA, 540 bp, Homo sapiens
  misc_feature: GYAE6OF02JBIZ5.51.76.G10.1.454.CMB.1.raw
  modified_base (195)..(195): a, c, t, g, unknown or other
  misc_feature (195)..(195): n is a, c, g, or t
  modified_base (282)..(282): a, c, t, g, unknown or other
  misc_feature (282)..(282): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctccncatctatgatgcatccacgaagggccactgatactcccagcccaggttcaggtgcaggtgggtctgggacagtacgttcacgttctacacctatcagcagcctgcagtctagaagtntttgacttaatttattacttgtcagtctagttaataattaacgtcggtacccttaccgtacctacgttttcggaccgtaggggaccaaggtcgtaggacgtaactacgaaacggtacgtggtacggcgtacgaccactacg

SEQ ID NO: 69266 - DNA, 495 bp, Homo sapiens
  misc_feature: GYAE6OF02HMHY1.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaacgggccactgatatcccagccaggttcagtggcagtgggtctggggacagagttcactctcacatcagcagcctgcagtctagaagtattttgctaattttatacttgtcagcagtataatactgcctcgtactacgtttcgccagggacaggctaggagatacgaaacgtactggtggctacgcacctacg

SEQ ID NO: 69267 - DNA, 636 bp, Homo sapiens
  misc_feature: GYAE6OF02IPYHA.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaacagcccaccctctcctgcagggccagtcagagtgtagcagcgacttagcctggtaccagcagaaacctggccaggctcccgaggctcctcatcgtatgatgcatccacgaagggccacgtgatactacccaggccaaggttcagtcggcaggtcggtacgtggacagtacgttcactctcaccatcagctagcctgacagtctagaacgtagttttacgacttaattttacttaacgttgtacgtaagtactaaggttaactaaacgtttaaccgtaccgggttaccctttaacccggttaaccgttaacccgttttttacggggaaccccggttaacggggggaacccttaagggtaccggtttacggggaataaaccgtttaaccggtaaaaaccgtaacggttacggtacggtccgtttaacggaccgtaccctaacg

SEQ ID NO: 69268 - DNA, 486 bp, Homo sapiens
  misc_feature: GYAE6OF02IDDTE.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcacatcagcagcctgcagtctgaagtattttgactaatttattactgtcagtcagtataataactgtcctcgtactactttgcctagggaccagctaggagatacaaacgactgtgctgcactac

SEQ ID NO: 69269 - DNA, 505 bp, Homo sapiens
  misc_feature: GYAE6OF02HFK17.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgaagtattttgacttaatttattacttgtcagcagtataataactgccttcgtactacgtttcgaccgtacgggaccaaggctaggagaatacgaaacgtactaggtggactgaccacctacg

SEQ ID NO: 69270 - DNA, 589 bp, Homo sapiens
  misc_feature: GYAE6OF02F1O3C.51.76.G10.1.454.CMB.1.raw
  modified_base (206)..(206): a, c, t, g, unknown or other
  misc_feature (206)..(206): n is a, c, g, or t
  modified_base (366)..(366): a, c, t, g, unknown or other
  misc_feature (366)..(366): n is a, c, g, or t
tcagcgatcgtatacacgaccggtgctcgatttagtcactcatacagggggtaggaactgctcagttaggacccagacggaacccatggaagccccagccgcagcttctcttcctcctgcgtacctctggctcccaggactaccactcggagaacgtagtgatgacgcagtctccagccaccctgtctgtgtctccaggggaaagngccgaccctctcctgccgaggggccaggtcagagtgttagcagcgacttagcctggtaccagcagaaacctggccaggctacccaggctcctcatctatgatgcatccacacgggccactgtactatcccagccaggttcagtggcagtggtctgggacngtagttcactctcacatcgagcagctgtcgagtcgtagaacgtattttacgcttaactttattaccgtgttaccgtacgtacgtacgttagtaaacttaacgttcgggtaccgttacccgtacttaccgttttcgggaccctacgggggaaccctaacggtcgtacggtacgtaccgttaccgaaacgtaccgttcggtacggtactacggacctacctaccg

SEQ ID NO: 69271 - DNA, 540 bp, Homo sapiens
  misc_feature: GYAE6OF02GZZVI.51.76.G10.1.454.CMB.1.raw
  modified_base (195)..(195): a, c, t, g, unknown or other
  misc_feature (195)..(195): n is a, c, g, or t
  modified_base (413)..(413): a, c, t, g, unknown or other
  misc_feature (413)..(413): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaacctggccaggctcccaggctcctcatctatgatgcatccacgaagggccactgactactcccagccaggttcagtggcaggtgggtctgggactaggagttcactctcaccatcagcagcctgcagtctagagttatttgacttaatttattactntacagtactaagttaataacttaacgtacgtccttaccgtacttacgtttggaccgtacgggtaccaggtcgtaggaacgtactaacgaaacgtacgtacggtacggtacgtacgtaaccgtatacg

SEQ ID NO: 69272 - DNA, 546 bp, Homo sapiens
  misc_feature: GYAE6OF02FFPNL.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggagggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccatgatactcccagccaggttcaggtggcaggtgggtctgggacagtgttcactctcaccatcagcagcctgctagtctagtaagtatttgacttaatttacttacttgtactagtcagttataattaacgtcggtacctccgtaacgtacgttttacgggacccgtaggggaaccaaggtcgtagggaacgtaacgtacgaaacgtaacgttaggtacggtcgtacgtacctacctacg

SEQ ID NO: 69273 - DNA, 549 bp, Homo sapiens
  misc_feature: GYAE6OF02H0R82.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggctcctcatctatgatgcatccacgaacgggccatgatactcccagccaggttcagtggcaggtggtcgtggggacaggtacgtttccacttctccgaccatcagcacgcctgctagtctagaagtatttgactaattttattactgtcagtctaagtaataataacgtcggtcccttccgtaactaccgttttcgggaccgtacggggtacctaaggtcgtagggagtaacgtaaccgaaacgtacgtggtacggtctacgaccacctacg

SEQ ID NO: 69274 - DNA, 609 bp, Homo sapiens
  misc_feature: GYAE6OF02HKIP9.51.76.G10.1.454.CMB.1.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
tcagcgatcgtatacacgaccggtgctcgatttagtcactcatacagggggaggaacgtgctcagttaggacccagacggaaccatggaagcccagcgcagcttctcttcctcctgctactctggctcccagataccactggagaagtagtgatgacgcagtctccagccaccctgtctgtgtctaccaggggaaaangccaccctctcctgcagggcctagtcagagtgtancagcgattagcctgaccagcagaacnggccaggtctcccaggctctcatctatgactgcatccaacgaacggtccaactgatacgtaccccaggcctaaggttccaaggttcggcaggtttgggcctagggacagtacgttcactcgtcacatcagcgacgcctgctacgtcgtagaagttagtttacgtacttaatttaacttaactagttacgtacgtacgtaattaacgtaaataacttacggtaccttaccgtaacgttaaccgttttacggaccggttaacggggtaccgtaacggtacggttacggaacggtaacgtaacgtaaaccggtaaccgttaggtaaccggtacgtacgtaccgaccgttaacg

SEQ ID NO: 69275 - DNA, 535 bp, Homo sapiens
  misc_feature: GYAE6OF02JPCHN.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaacctggccaggctcccaggctcctcatctatgatgcatccacaagggccactgatactcccagccaggttcagtcggcaggtggctgggacagtgtccactctacaccgatcagcagcctgcagtcgtagaattagtttgacttaatttattactgtacagtacctagttaataattacgacgtaccttccgtactacgtttcggaccgtacgggtacaaggtcgtaggacgtaacgtacgaaacgtacgtggtacggtaccgcgtacaccctag

SEQ ID NO: 69276 - DNA, 557 bp, Homo sapiens
  misc_feature: GYAE6OF02GOX1X.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccaacgaagggccactgactactcccagccaggttcagtggcaggtgggtctgggacagagttcactctacaccatcagcagcctagcagtctgaagtatttgacttaatttattactgtacagtactaagttaataattaacgtcggtacccttaccgttacttaaccgttttcggaccggtacggggaccgtaaggtcgttagggaacgtacgttaaccgaaacggtaacgttcggtaggtacctcgtaccaccgtac

SEQ ID NO: 69277 - DNA, 530 bp, Homo sapiens
  misc_feature: GYAE6OF02IUXXQ.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (282)..(282): a, c, t, g, unknown or other
  misc_feature (282)..(282): n is a, c, g, or t
  modified_base (351)..(351): a, c, t, g, unknown or other
  misc_feature (351)..(351): n is a, c, g, or t
  modified_base (382)..(382): a, c, t, g, unknown or other
  misc_feature (382)..(382): n is a, c, g, or t
  modified_base (388)..(388): a, c, t, g, unknown or other
  misc_feature (388)..(388): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctntcctgcagggccagtcagagtgttagcagcgacttagcctggtaccagcagaacctggccagcctcccaggctcctnatctatgatgcactccaacagggccactgactatcccagccaggtcaggtgcaggtcggtctgggaacngtacgttcactccgtacaccatcagcagccngcagtntagaatatttgacttatttattcgtgtcagctagttataactaacgtcgaccttccgtacttacgtttcggaccgtagggacctaaggtcgtaggaacgtacgtaacgaaacgtacgtacggtcggactcggactacctacg

SEQ ID NO: 69278 - DNA, 542 bp, Homo sapiens
  misc_feature: GYAE6OF02IMUQC.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagcccaccctctcctgcagggccagtcagagtgttagcagcgacttagcctggtaccagcagaaacctggccaggctcccaggctcctcatctatgatgcatccacagggccactgatactcccagccaggttcagtggcaggtgggtctgggacagagttcactctcaccatcagcagcctgcagtctagtaagtagttttgacttaattttattacttgtacagtactagttaataacttaacgtcggtacccttaccgtaacttaccgttttcgggaccgtacggggacctaaggtcgtaggacgtacgtacgaaacgtacgtggtggtactcgacctactacg

SEQ ID NO: 69279 - DNA, 515 bp, Homo sapiens
  misc_feature: GYAE6OF02IOBIP.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgattagcctggtaccagcagaaacctggccaggcctcccaggctcctcatctatgatgcatccacaaggccatgatactcccagcaggttcagtgcaggtgggtctgggacaggtagttcactctcaccatcagcagcctgcagtctagaagtatttgactaatttattacgtgtactagtactagtataatactcggtccttaccgtactacgtttggaccgtacgggacctacgcgtaggagtagtacgaacgtactggtacgcgtcgtcactacg

SEQ ID NO: 69280 - DNA, 501 bp, Homo sapiens
  misc_feature: GYAE6OF02HNWKM.51.76.G10.1.454.CMB.1.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacgaaggccactgatatcccagccaggttcagtgcaggtggctgggacngtagttcactctacacatcagcagcctgcagtctagagtatttgactaatttattactgtcagctagtataataacgtgtacctccgtactacgtttcgaccgtacgggacctagcgtggagtagtacgaacgacgtcgtagtctgccacctac

SEQ ID NO: 69281 - DNA, 538 bp, Homo sapiens
  misc_feature: GYAE6OF02HWFQC.51.76.G10.1.454.CMB.1.raw
  modified_base (196)..(196): a, c, t, g, unknown or other
  misc_feature (196)..(196): n is a, c, g, or t
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatactcccagcctaggtcagtgcnggtggtctgggacagagttcacttcncacactcngcagcctgcagtctagaagtattttgtactaattttattactgtcagacattataaataacgtcggtccttaccgtactaccgttttacggaccgtacggggaccaaggtcgttagggacgtaataccgaaacgtaaccgtggtacggaccgttagtaccacgtaaccg

SEQ ID NO: 69282 - DNA, 518 bp, Homo sapiens
  misc_feature: GYAE6OF02I5CBV.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggctgggacagagttcactctcaccatcagcagcctgccagtctgaagtatttgacttaatttattacttgtcagtctagttataataacttggaccttccgtactacgtttggccgtaggggacctaaggcgtaggacgattacgaaacgtaacgtcggtacggctacggactactacg

SEQ ID NO: 69283 - DNA, 678 bp, Homo sapiens
  misc_feature: GYAE6OF02J3KXF.51.76.G10.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgcccaccctctcctgcagggccagtcagagtgtagcagcgacttagcctggaccagcagaacctggccaggctcccaggcctcctnatctatgatgacactccgagaacgggccacgtgactacgtcccgagtccgtaggttcaggtcggcgtagggtcggtcgtagggactaggtacgtttcacccgtctaccgaaccgtagtaccacggtaccgacgtcccgtagtacctacggttaccgtaggtaaccgtttagttttacgaaccttttaagtttacgttacgttacgtactaacgtactaacgttaactttaaaccgttaccggttaccggttacccgttaccgtttaaccgttacggttttaccgggacccggtacgggtaacccgttaacggtccggtaacggtaacggtaaccgttaacccggaaacgttaaccggttcggtacgggttaccctacggtaccctaccgttaccg

SEQ ID NO: 69284 - DNA, 542 bp, Homo sapiens
  misc_feature: GYAE6OF02ICDB6.51.76.G10.1.454.CMB.1.raw
  modified_base (195)..(195): a, c, t, g, unknown or other
  misc_feature (195)..(195): n is a, c, g, or t
  modified_base (360)..(360): a, c, t, g, unknown or other
  misc_feature (360)..(360): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcaggccagtcagagtgttagcagcgacttagcctggtaccagcaagaaacctggccaggctccgaggcctcctcatctatgatgcatccacaagggccactgatactccagccaggttcagtggcagtgggtctggggacagagttcacgtntccaaccatcagcagcctgcagtctagaagttatttgactaatttattactgtactagtactaagttataaataacgtcggtaccttaccgttactacgttttcggaccgtacggggacctaacggtcgtaggagtaacgttaacgaaacgtacgtagtacggtcgtacggtaccaccgtac

SEQ ID NO: 69285 - DNA, 507 bp, Homo sapiens
  misc_feature: GYAE6OF02HS22U.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttagcagcgacttagcctggtaccagcagaacctggccaggctcccaggctcctcatctatgatgcatccacaagggccactgatatcccagccaggtcagtgcagtggtctgggactagagttcactctcaccatcagcagcctgcagtctgaagtatttgactaattttattactgtactagctagtataataactcgtaccttccgtactacgttttcgaccgagggtaccaaggtctggacgtatacgaaacgactcggtacggactcgcactacg

SEQ ID NO: 69286 - DNA, 543 bp, Homo sapiens
  misc_feature: GYAE6OF02G1L2M.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtgcagtggtctgggacagagttcactctacacatcagcagcctgcagtctagaagtatttgactaatttattactgtctagctaagttataaattaactacggtcccttaccgttaactacgtttttcggaccgtacggggacctaacggtccgtagggaacgtaactaacgaaaacggtacgtacggtcggtaccgtacggtaccacgtacg

SEQ ID NO: 69287 - DNA, 530 bp, Homo sapiens
  misc_feature: GYAE6OF02GJFPK.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgactatcccagccaggttcagtggcagtgggctgggacagagttcactctcaccatcagcagcctgcacgtctgaagtattttgacttaatttattactgtcagtcagttaataacttaacgtcggtaccttccgtactacgttttcgggaccgtaggggacctaaggcgtaggaacgtaacttacgaaacgtaacgtggtcggactacgaccacctacg

SEQ ID NO: 69288 - DNA, 506 bp, Homo sapiens
  misc_feature: GYAE6OF02HSASS.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctccccaggcctcctcatctatgatgcatccacaagggccactgatactcccagccagttcagtggcaggtggtctgggacagagttcactctcacatcagcagcctgcagtctagaatatttgactaattttattactgtcagctaagtataataactcgtccttcgtactacgtttggaccgacggggaccaggcgtaggagacgtacgaaacgacgtggtagctagcctactac

SEQ ID NO: 69289 - DNA, 555 bp, Homo sapiens
  misc_feature: GYAE6OF02H8XC5.51.76.G10.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgattagcctggtaccagcagaaacctggccaggctcccaggcctctcatctatgatgcatccanaacgggccactgatactccgagccagttcagtggcaggtggtctgggacagagttcacttcaccacatcagcagcctgcagtctagaacgttatttagtactaaattttaacgttactgtactagactaagtaactaaagttaacctcggtaccttaccgttactaacgttttcggaccgtaacggggacctaaggtcgtaggtaagaacgttaaccgaaacgtaacgtcggtacggtacgtcgtaccgaacctac

SEQ ID NO: 69290 - DNA, 536 bp, Homo sapiens
  misc_feature: GYAE6OF02GB5DY.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggcctcctcatctatgatgcatccacaagggccatgatactcccagccaggttcagtggcaggtgggtctgggacagagttcactctcaccatcagcagcctgcagtctagaagtatttgactaatttattactgtcagctaagtataattaactcgttaccttaccgttacttacgttttcggaccgtacggggaccaacggtcgtagggtagtaacgtacaaacggtaacttggtacggtctacggacctacctacg

SEQ ID NO: 69291 - DNA, 558 bp, Homo sapiens
  misc_feature: GYAE6OF02GEEWY.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagcctaggttcagtggcagtgggtctgggacagagttcactctcaccatcagcacgcctgcagtctagtaagtattttgacttaatttattactgtacagtctaagttataaattaacgtcggtacccttaccgtaacttaccgttttacgggaccgtacggggaacccgaaggtcgtagggacgtaacgttaaccgaaaacggtaacgtcggtacggtactacggacctaccgtaacg

SEQ ID NO: 69292 - DNA, 512 bp, Homo sapiens
  misc_feature: GYAE6OF02HHWP7.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcatctatgatgcatccacgaacgggccactgatactcccagccaggttcagtggctaggtcgggtctggggacagtagttcacttctcaccatcagcagcctgcagtctagaagtatttgcttagtttattatgtcagcagtactaacactgtcttcgttcgttcgggcggtagggactaagggtggagactacgaaacgtacgtggtacggctgacctactgtctcg

SEQ ID NO: 69293 - DNA, 647 bp, Homo sapiens
  misc_feature: GYAE6OF02F3Y9O.51.76.G10.1.454.CMB.1.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
tcagcgatcgtatacacgaccggtgctcgatttagtcactcatacaggggtaggaactgctcagttagacccagacggaaccatggaagccccagcgcagcttcgtcttcctcctgctacttctggctcccagataccactggagaagtacgtgatgacgcagtctccagccaccctgtctgtgtctccaggggaaancgccaccctctcctgcagggccagtcagagtgttagcagcgacttagccgtggtaccagcagaaacctggaccaggtcctcccaggctcctnattctaatggattcgacctatccaataacgggccactgatactcccaagcctaaggttcaaggttcgggcctaaggttcgggtcctggggaactaggtacgttcgacgttcctacgaccatcacgacacgcctacgcacgtactacgaagtacgtttacgacgttaagtttacttacgtagtacgtagtacgtaagttaacttaaacttaacgttacggtaccttaaccgttactaacgtttttacggaccggttacgggtaaccgtaacggttcggttacgggtaacggtaacgttaaccgtaaaccggttaacgttacggttacgggtaccttaacggtaccgtacgttaaccgg

SEQ ID NO: 69294 - DNA, 502 bp, Homo sapiens
  misc_feature: GYAE6OF02JJOHG.51.76.G10.1.454.CMB.1.raw
  modified_base (284)..(284): a, c, t, g, unknown or other
  misc_feature (284)..(284): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
  modified_base (502)..(502): a, c, t, g, unknown or other
  misc_feature (502)..(502): n is a, c, g, or t
tcagcgatcgtatacacgaccggtgctcgatttagtcactcatacagggggagggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaacctggccaggctcccaggctccncatctatgatgcatccanaagggccatgatacncccagccaggttcagtggcaggtggctgggacagnttcactcncgaccatcagcacgcctgcagtctagaagttatttgactaatttacttactgtacagctagtaataataacgtcgccttccgtactacgtttcggccgagggaccagtctaggagactacaacgtacgtgtgctcgacactn

SEQ ID NO: 69295 - DNA, 503 bp, Homo sapiens
  misc_feature: GYAE6OF02I3S0G.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggcctcccaggctcctcatctatgatgcatccacaagggccactgatatcccagccaggttcagtggcagtggtctgggacagattcactctcaccatcagcacgcctgcagtctagaagtatttagacttaatttattactgtcagcagtacgtaacacgtcgacttctcgttcggcggacggacgaggtggtagatacgaaacgtacgtggtacggctagacctactagtctacg

SEQ ID NO: 69296 - DNA, 561 bp, Homo sapiens
  misc_feature: GYAE6OF02HE9OR.51.76.G10.1.454.CMB.1.raw
  modified_base (317)..(317): a, c, t, g, unknown or other
  misc_feature (317)..(317): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggcctcccaggcctcctcatctatgatgcatccacaaggccatgatacnccagccaggttcagtgcagtggtctgggacagagttcacgtctcacatcagcacgcctgcagtctagaagtatttgacttaattttattacttgtacagtactaagttataaacttaacgttcggtacccttaccgttacgttaccgttttacgggaccgtacggggaaccctaacggtcgtaggtaacgtaacgtaacgtaaaacggtaacgttacggtacggtacgtacgtaccacccgtac

SEQ ID NO: 69297 - DNA, 549 bp, Homo sapiens
  misc_feature: GYAE6OF02HR56E.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatactccagccaggttcagtgcagtggtctgggacagagttcactctcaccatcagcagcctgcacgtctagaagtattttgtactaattttattactgtacagtctagttataataacgtcggtaccttcccggtaactaccgttttcggaccgtacggggacctaacggcgttacggaggtaacgtaacctaaaacggtaacgttacggtacggtacgtcgtaccgtaccctaacg

SEQ ID NO: 69298 - DNA, 550 bp, Homo sapiens
  misc_feature: GYAE6OF02HFHCV.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctagtaagtatttgactaatttacttacttgtactagtactaagtataataactacggtaccttaccgttacttaccgttttcgggacccgtacggggtacctaacggtcgtacggaacgtaacgtaccgtaaacggtaacgtaggtacggcgtacgacccacctaccg

SEQ ID NO: 69299 - DNA, 523 bp, Homo sapiens
  misc_feature: GYAE6OF02IPSV1.51.76.G10.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagcccaccctctcctgcagggccagtcagagtgttagcagcgacttagccctggtaccagcagaacctggccaggctcccaggctcctcatctatgatgcatccanaagggccatgatatcccagccaggttcagtggcagtgggtcngggacagngttcactctcacatcagcacgcctgctagtcgtagtaagtattttagacttaatttatttactgtctagtacgtaagttataataacgtcgtccttaccgtactacgtttcggaccgtacgggacctacgcgtggagaatacgaacgtacgtgtaggcgtacgacactacg

SEQ ID NO: 69300 - DNA, 495 bp, Homo sapiens
  misc_feature: GYAE6OF02F9B2O.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctgagtattttgctaatttattactgtcagctagtataatactgtcctccgtactactttcggccgtagggaccaggtctaggagtatacgaacgacgtgtaggctcgcactacg

SEQ ID NO: 69301 - DNA, 636 bp, Homo sapiens
  misc_feature: GYAE6OF02J1T5U.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcacgggccagtcagagtgtagcagcgattagcctggtaccagcagaacctggaccaggctcccgaggtcctcctcatctatgatgactactcccgaagaacgggccaacgtgactacgtcccaagtccgaaggtttcacggtggacgtagggtcgggtacgtgggactaagggtcgtttccaacgttcctacgacctagtcgaacgtcaaccggtcctagccacgttcgtagtaagttacgtttgtaactttaactttacgttacttagtacgtaacgtacgtaacgttaattaaacttaacgttcgggtacccttaccgttaaccttcggttttacgccggtaacgggaccgtaacggtacgtacggaacgtaacgtaaccgaaaggtaccttagggtacgtaccgtacgtacggtacccctaag

SEQ ID NO: 69302 - DNA, 552 bp, Homo sapiens
  misc_feature: GYAE6OF02GNTPQ.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacgaacgggccacgtgactactcccagcctaggttcagtggcaggtgggtctggggactaggtagttcacgttcctacaccatcagcagcctagcagtctagaagtattttcgacttaatttattctgtctagcagcgtaacacgtcggccttcgttcgttacgggacggacgggtactaagggtcggaacggtaactacggaaaacgttacgtagggtacggtcgtacgaccgtacccgtagttccgttaccg

SEQ ID NO: 69303 - DNA, 554 bp, Homo sapiens
  misc_feature: GYAE6OF02IVCN8.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggcctcccaggctcctcatctatgatgcatccacgaacgggccactgatactcccagcctaggttcagtcggcaggtgggtctggggacaggtacgttccacgtctaccacctactcagcacgcctgctagtctagtaagtatttgacttaattttattactgtacagtactagttaactaataacgtcggtaccgttccgttaacttcgttttacggaccgtacggggtaaccaggtcgtaggaagtactacgaaacgtacgtaggtcgcgtacgacacctacg

SEQ ID NO: 69304 - DNA, 489 bp, Homo sapiens
  misc_feature: GYAE6OF02GMY7C.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgtagcagcgacttagcctggtaccagcagaaacctggccaggctcccaggctcctcatctatgatgcatccacaagggccactgatatcccagccaggttcagtggcagtggtctgggacagagttcactctcacatcagcagcctgcagtctgaagtatttgctaatttatactgtcagctagtataataactgtcctcgtactactttgccgagggaccaagcgtaggagatacgaaacgaactgtagctcgacactacg

SEQ ID NO: 69305 - DNA, 576 bp, Homo sapiens
  misc_feature: GYAE6OF02JO9KQ.51.76.G10.1.454.CMB.1.raw
  modified_base (198)..(198): a, c, t, g, unknown or other
  misc_feature (198)..(198): n is a, c, g, or t
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (326)..(326): a, c, t, g, unknown or other
  misc_feature (326)..(326): n is a, c, g, or t
  modified_base (471)..(471): a, c, t, g, unknown or other
  misc_feature (471)..(471): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagccaccctctcctgcagggccaggtcagagtgtagcagcgacttgcctggtaccagcagaacctggccaggctcccaggctcctnagtctangatgacatccgaacgaagggcccactagattaccncccgagccgtaaggttcaggtcggacgtaggttcgggtcagggacaggtacgttccacctcgtacaacctgtacagtaccgacgtccgtgacctaggttacctaggtaaattgttttacgacttaaagttttacttacgtcgtancgtagtaattaagttaactacgtccgtaccttacctaacgtttacgttcgaccgtacggactaacgtgtacggagtacaacgtaagctggtcgactgcctagtac

SEQ ID NO: 69306 - DNA, 517 bp, Homo sapiens
  misc_feature: GYAE6OF02FN8QO.51.76.G10.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccanaagggccactgatatcccagccaggttcagtggcagtggtctgggacagagttcactctcaccatcagcagcctgcagtctgaagtatttgctaatttattactgtacagtcagtataattaactcgtacctccgtactacgttttcggaccgtacggggaccaacggtctagggagtaacgttacaaacgtacgtggtacggctagaccactacg

SEQ ID NO: 69307 - DNA, 615 bp, Homo sapiens
  misc_feature: GYAE6OF02JFOZD.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccagcaaagaacctggccaggcctcccaggctcctcatctatgatgcatccaacaagggccactgaactactccccgagacccgtaggtttccaaggtttcggaccgagggtttggggtccgtaggggaacctagggtacgtttccgacttcgtaccacctactcgacgcacgcctcgctacgtacgtacgtaagttactttacgtactaagtttacttacttacgtactagtactaagttaataacgttaacgtcgtaccttacgtacttacgttttacgaccggtagggtaaccgtaacggtcgttacggtacggtaacgtacgtaaacgtaacggttcgtacggtacgtacgtacgtaccgtacg

SEQ ID NO: 69308 - DNA, 502 bp, Homo sapiens
  misc_feature: GYAE6OF02HL2MT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatccagccagttcagtgcagtggctggacagagttcactctcacatcagcagcctgcagtctagaagtatttagctaatttattactgtcagctagcgtagctaagttcgcctccctcgtactcctaccttcggaccgtaagggaccacggacgtaggaagaactaacgaacttggtacggctagacc

SEQ ID NO: 69309 - DNA, 559 bp, Homo sapiens
  misc_feature: GYAE6OF02F4M95.51.76.G10.1.454.CMB.1.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaaacctggccaggcctcccgaggcctccctnatctatgatgcatccagacggccacgtgactcnccagcctaggtcaggtcggcaggtgggtcgtgggacaggtacgttcacgttccacactactcgacgcacgcctgcagtctagagttatttgacttagtttacttactgtcgtacgtactagttaacttaacgttacgtcggtacccttaccgtaccttacgttttacggaccgtacggggtacctacggtcgtaggacgtacgtaacgaaacgtacgtggtacggactcgaccacgtac

SEQ ID NO: 69310 - DNA, 554 bp, Homo sapiens
  misc_feature: GYAE6OF02I0H29.51.76.G10.1.454.CMB.1.raw
  modified_base (198)..(198): a, c, t, g, unknown or other
  misc_feature (198)..(198): n is a, c, g, or t
  modified_base (422)..(422): a, c, t, g, unknown or other
  misc_feature (422)..(422): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccgaggggaaanacgcccaccctctcctgcagggccagtcagagtgtagcagcgacttagcctggtaccagcagaacctggccaggcctcccgaggcctctcatcgtatgatgcactccaacgacgggccacgtgactactcccgagcccgtaaggttcaaggtcggctagggttcggtactgggaacaggtagttcacttcgtaccacatcagcacgcctgcagtctagaagttntttgacttaatttactactgtacagtactagttataataacgtcgccttacgtacttacgtttgaccgtacgggacaaggtcgtaggactacgtacgaaacgtacgttggtacggctacggacctacgtacg

SEQ ID NO: 69311 - DNA, 778 bp, Homo sapiens
  misc_feature: GYAE6OF02I3G6D.51.76.G10.1.454.CMB.1.raw
  modified_base (218)..(218): a, c, t, g, unknown or other
  misc_feature (218)..(218): n is a, c, g, or t
tcagcgatcgtatacacgaccggtgctcgatttagtcactcatacagggggaggaactgctcagttaggacccagacggaaccatggaagcccagcgcagcttctcttcctcctgctactctggctccagataccactggagaagtagtgatgacgcagtctccacgccaccctgtctgtcgtctccgagggaaagacgccaccctctcctcgcgacngggtccaaggtcaggtagtcgttaaggccaagtcgacctttaggccctagggtaccaggaccaggaaaccctgggactacggacgtccccaagggtcctaccgttccaattccgtaattcggacttaggccaataccgaacaaacgggtccaacgttcgaacctagtccccaaaggtcccaaggggtttccgaacggttacgggacgtaacggttcgggggtacctacgggggaacctacgggaacggtttccaaccgtttaccttaccgtaacccgtaacgtaccgaacggtacccgtaacggtacccgtacggtaccgtaacggtaccgttacggttaaacggttaacgtttttaacgttaacgtttaaacatttttaacgtttaaccgttagttaccgttaacgtacgtaacgttaaagttaacgttaaacctgggggtaccctaacccggttttaaccgaaccttttttaggggtaccctaaaacgggaccgttaacggtaaccgtacggtacggtaacgtacctaaaccggtaaacgtacgttacggtacgtacg

SEQ ID NO: 69312 - DNA, 593 bp, Homo sapiens
  misc_feature: GYAE6OF02JX7ME.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaangcccaccctctcctgcagggccagtcagagtgtagcagcgacttagcctggtaccagcagaaacctggaccaggcctcccgaggtcctcctcatctatgatgccatccaacgacggccatgactactcccaagccaggttcaggtcgctaggtgggtcgtgggactagtacgttccactcctacactatcgacgcacgtccgtgcacgttcgtagtaagttgtttacgaactttaattttacttactgtacgtagtactaaggttaataacgttacgtaccggtacccttacgtacttacggtttaccggaccgtacgggtacctaaggtcgtaaggtaacgtaaccttaaccgaaacggtacgttacgggtacggtacgtcggtactagttaccg

SEQ ID NO: 69313 - DNA, 533 bp, Homo sapiens
  misc_feature: GYAE6OF02F7USI.51.76.G10.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagngtgttagcagcgacttagcctggtaccagcagaaacctggccaggctcccaggctcctcatctatgatgcatccacgaggccactgatactcccagccaggttcagtgcagtggtctgggacagtgttcactctcaccatcagcagcctgcagtctagaagtatttgctaatttattactgtacagctaagttataacttaacgtcgtaccttaccgtactacgttttcggaccgtacggggtacctaaggtcgtaggacgtaactaccgtaaacgtaacgtacggtacggtactacgacctaccgtacg

SEQ ID NO: 69314 - DNA, 667 bp, Homo sapiens
  misc_feature: GYAE6OF02FOHV8.51.76.G10.1.454.CMB.1.raw
tcagcgatcgtatacacgaccggtgctcgatttagtcactcatactaggggtagggaactgctcagttaggacccagacggaaccatggaagccccagcgcagcttctcttcctcctgctactctggctcccagataccacgtgaagtagtagtgatgacgcacgtctccacgtccacccttgttcctggtagtcgtccacgggtaacacgccaccctcgtccctagccagggcctagtcagtagttgttacgcgacgacgaaacctttaggccctaggtacccacgaccgagtaaaccctggcccaaggtccttacccgaggccttaccctactactaccgtaagtcgaacttcggacctaactccccaacgaaccggtcctacgtggacttacgtacccgaggtccgtaggttaccaggtcgtccgagttcgggtacttacggactacgacgttccacgtcctacgacccgtagtaccgagtccacgtccttgacctagttcgtagtacgttagtttcgacgttaacgtttacgtactgtacctagtctagtactaacgtacgtacggtcctacgtacgtacgttacggaccgtagggacctaggtccgtaggtacgtactaccgtaacgtcttacggtaccgtccgtacgtaccgtaccgttcg

SEQ ID NO: 69315 - DNA, 510 bp, Homo sapiens
  misc_feature: GYAE6OF02ISGJT.51.76.G10.1.454.CMB.1.raw
  modified_base (393)..(393): a, c, t, g, unknown or other
  misc_feature (393)..(393): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgacttagcctggtaccagcagaaacctggccaggctccccgaggctcctcatctatgatgcatccacaagggccactgatatcccagccaggttcagtggcagtgggtctgggacagagttcactctcaccatcagcagcctgcagtctagaagtntttgctaattttattactgtactagctagtataatactgccttcgtactacgtttggaccgtagggacctaagcgtaggagtaactacgaaacgactaggtggacttgaccactacg

SEQ ID NO: 69316 - DNA, 552 bp, Homo sapiens
  misc_feature: GYAE6OF02FTFR4.51.76.G10.1.454.CMB.1.raw
  modified_base (348)..(348): a, c, t, g, unknown or other
  misc_feature (348)..(348): n is a, c, g, or t
  modified_base (397)..(397): a, c, t, g, unknown or other
  misc_feature (397)..(397): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcaagaacctggccaggcctcccaggctcctcatctatgatgcactccacaacgggccactgatactcccagccaggttcagtggcaggtggtcngggacagtgttcactctcacatcacgcacgcctgcagtctagtaagttntttcgacttaatttacttactgtacagtacaagttaataataacgttcgtaccttaccgtacttacgtttacggaccgtacgggaacctaacggtcgtacgggtacgtaacgtaccgaaacgtacgttacggtacggtctacgtaccgtactacg

SEQ ID NO: 69317 - DNA, 667 bp, Homo sapiens
  misc_feature: GYAE6OF02H8Z6U.51.76.G10.1.454.CMB.1.raw
  modified_base (204)..(204): a, c, t, g, unknown or other
  misc_feature (204)..(204): n is a, c, g, or t
tcagcgatcgtatacacgaccggtgctcgattttagtcactcatacaggggggtagggaactgctcagttaggaccccagacggaaccatggaagccccgagcgcagcttctcttcctcctgctactctggctcccagataccactggagaagtagtgatgacgcagtctccagccaccctgtctgtgtctccgaggggaaaancgccaccctctcctgcagggccagtcagagtgttagcagcgacttagcctggtaccagcagaaacctggccaggcctcccaggctcctctatctatgtatgcactccacgaagggccaactcgaatactcccagcctaggttcagtggcagtgggtctgggacagagttcactctccacatcacgcacgcctcgacacgttacgtacggtaagttactttttacgacttaactttttaactttacttacgttaccgtacgtactaacggttaaatttaaacttaaaccgtttacgggtaccctttaacccgttacccgtttaaacggtttttaccgggtacccggttaaccgggggtaacccgtaaacgggtacggttaacgggtaacggtaacgttaaccgtaaaaacccggtaacggttacgggttaccggtaccgtacggtacccctaacccgttaaccg

SEQ ID NO: 69318 - DNA, 505 bp, Homo sapiens
  misc_feature: GYAE6OF02FVDFL.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaacctggccaggctcccaggctcctcatctatgatgcatccacaagggccactgatactcccagccaggttcagtgcagtgggtctgggacagagttcactctcaccatcagcagcctgcagtctgaagtattttgactaatttattacttgtctagtactagtataataactaggtcctccgtactacgttttcgaccgtacgggaccaggctaggagacgtacaacgacgtgtaggctgaccactac

SEQ ID NO: 69319 - DNA, 556 bp, Homo sapiens
  misc_feature: GYAE6OF02IGP20.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggaccaggcctcccaggctcctcatctatgatgcatccacgaacgggccactgatactcccagcctaggttcaggtggctaggtgggtctgggacagtgttcactcctacaccatcacgcacgcctgctagtctagaagtatttgtacttaatttattactgtactagacgtaagttaataattaacgttcggtacccttaccgtacttacgttttacgggaccgtaggggaacctaggtcgtaggacgtaacgtacgaaacgtacgtacggtggacgtacgacctactacg

SEQ ID NO: 69320 - DNA, 525 bp, Homo sapiens
  misc_feature: GYAE6OF02GU77I.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaagagccaccctctcctgcagggccagtcagagtgttagcagcgacttagcctggtaccagcagaacctggccaggctcccaggctcctcatctatgatgcatccacaagggccactgatactcccagccaggttcagtggcaggtgggtctgggacagagttcactctcaccatcagcagcctgcacgtctagtaagtattttgacttaatttattactgtcagtcagttataataacgtcggtaccttccgtactacgtttcggccgtacggggacctaaggcgtacggacgtacgtacgaacgtaacgtggtggtctacgtccactac

SEQ ID NO: 69321 - DNA, 517 bp, Homo sapiens
  misc_feature: GYAE6OF02I9W58.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccacagggccactggcatcccagccaggttcagtgcagtgggtctgggacagacttcgctctcaccatcagcagcctagagcctgaagtatttgctagtttatattgtcagcagacgaaacactggcctcgttggacgttcggaccgaagggaccaaggtcgaaatcgaacgacgtgtaggctaggacctaccagtctcgtccttcacttcctcccgtcc

SEQ ID NO: 69322 - DNA, 558 bp, Homo sapiens
  misc_feature: GYAE6OF02IK91S.51.76.G10.1.454.CMB.1.raw
  modified_base (196)..(196): a, c, t, g, unknown or other
  misc_feature (196)..(196): n is a, c, g, or t
  modified_base (357)..(357): a, c, t, g, unknown or other
  misc_feature (357)..(357): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaaacctggccaggcctcccaggcctcctcatctatgatgcatccacaagggccactgatactcccagccagttcagtggctaggtgggtctgggacagngttcactcctcaccatcagcacgcctgcacgtctagtaagttattttcgacttaatttattaacgtgtctagtactaagttaataaattaaccgtcgacccttccgttaaccttacgttttacgggaccgtacggggacctaacggtcgtaggacgtaactaccgaaaacgtacgttacggtggaccgtcgaccaccgtac

SEQ ID NO: 69323 - DNA, 514 bp, Homo sapiens
  misc_feature: GYAE6OF02HQB4V.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacaggagttcacttctcaccatcagcagcctgcagtctgaagtatttgactaattttattactgtcagctagtataataactgtcctaccgtactactttcggacctaggggaccaaggtctaggtagaacgtacgaaacgtactggtacggtactcgaccactacg

SEQ ID NO: 69324 - DNA, 522 bp, Homo sapiens
  misc_feature: GYAE6OF02HREZ6.51.76.G10.1.454.CMB.1.raw
  modified_base (196)..(196): a, c, t, g, unknown or other
  misc_feature (196)..(196): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctggggacagtagttcacgtntccaccatcagcagcctgctagtctagaagtatttgtactaatttattactgtcagtctagtataataacgtgccttaccgtactacgttttcgaccgacggggtaccaaggcgtaggagtactacgaaacgtacgtacggtaggtcgtacgcactac

SEQ ID NO: 69325 - DNA, 542 bp, Homo sapiens
  misc_feature: GYAE6OF02JRY4P.51.76.G10.1.454.CMB.1.raw
  modified_base (195)..(195): a, c, t, g, unknown or other
  misc_feature (195)..(195): n is a, c, g, or t
  modified_base (296)..(296): a, c, t, g, unknown or other
  misc_feature (296)..(296): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangcccacctctcctgcagggccagtcagagtgtagcagcgacttagcctggtaccagcagaacctggccaggctccaggctcctcatctatgatgcatccanaacggccactgactactcccagtccaggttcagtggcaggtgggctgggactaggtacgttcacttctaccacctatcacgcacgccgtgtcgagtctagtaagtagtttcgacgttaatttacgttacttagtacagtactaagtacttaagtaacgtcgtaccgttaccgtaacttacgtttcgaccgtaggacctaagtcgtaggacgtatacgaaacgtacgtgtacgctacgacgactacg

SEQ ID NO: 69326 - DNA, 518 bp, Homo sapiens
  misc_feature: GYAE6OF02GOKQJ.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatatcccagccaggttcagtggcaggtgggtctgggacagagttcactctcaccatcagcagcctgcagtctgaagtagttttgacttaatttacttactgttacagtcagtataataactcgtacctccgtactacgtttgccgtagggacctaaggtcgtaggacgtacgtacgaaacgtacgttagtcgtactcgacaccgtacg

SEQ ID NO: 69327 - DNA, 521 bp, Homo sapiens
  misc_feature: GYAE6OF02IDJIX.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccagctcctcatctatgatgcatccagaaggccatgatatccagccaggttcagtgcagtggtctgggacagacgttcactctacaccatcagcacgcctgctagtctagtaagtattttagactaagtttattactgtacagctaagtataataacgtgtaccttaccgtactacgttttcggacctacggggaacctaaggtcgtaggacgtagtacgaaacgtacgtggtggctcgaccactacg

SEQ ID NO: 69328 - DNA, 512 bp, Homo sapiens
  misc_feature: GYAE6OF02I1ST9.51.76.G10.1.454.CMB.1.raw
  modified_base (196)..(196): a, c, t, g, unknown or other
  misc_feature (196)..(196): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtgcagtgggctgggacagngtcactctcaccatcagcagcctgcagtactagaagtagttttgactaatttattactgtcagtacagttataataactcgaccttccgtactacgttttgcctagggacctagtcgtaggagatacgaacgtaacgtcgtaggtactcgacgtacctacg

SEQ ID NO: 69329 - DNA, 584 bp, Homo sapiens
  misc_feature: GYAE6OF02JNX0T.51.76.G10.1.454.CMB.1.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (417)..(417): a, c, t, g, unknown or other
  misc_feature (417)..(417): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgtagcagcgacttagcctggtaccagcagaaacctggccaggctcccaggcctccncatcctatgatcgcactaccacgaacgggccacgtgatactcccagccctaggttcaggtcggctaggtgggtcgtgggaacaggtacgttccacttctaccgaccatcgagcacgcctagctagtcgtagaagtntttacgacttaattttattactgtactagtactaagttaattaacgttaaaccgttcggtacccttaccgttaacttaccgttttcggacccgtacgggaaccctaaggtccgttaggactaacgtaacgtaaacggaacgttggtacggctacggcctaaccgtag

SEQ ID NO: 69330 - DNA, 521 bp, Homo sapiens
  misc_feature: GYAE6OF02HQQDI.51.76.G10.1.454.CMB.1.raw
  modified_base (347)..(347): a, c, t, g, unknown or other
  misc_feature (347)..(347): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatactcccagccaggttccagtggcaggtgggtcngggacagagttcactctcaccatcagcagcctgcagtctagaagtatttcgctaattttattactgtacagactagttataatactcggtcctccgttactacgttttcggaccgtaggggtaccaacggtcgtaggaagactacgaacgtacttggcgtctacgaccactacg

SEQ ID NO: 69331 - DNA, 498 bp, Homo sapiens
  misc_feature: GYAE6OF02GJ18Q.51.76.G10.1.454.CMB.1.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtggtctgggacagagttcactcncaccatcagcagcctgcagtcctagaagtattttgctaatttattactgtacagcagtataatactgcctccgtactacgtttcgccgagggaccagcgtaggagactacgaacgtaactggtaggcgtgacactac

SEQ ID NO: 69332 - DNA, 548 bp, Homo sapiens
  misc_feature: GYAE6OF02GR63H.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaacctggccaggcctcccaggctcctcatctatgatgcatccacgaagggccactgactactcccagccaggttcagtggctaggtggtctgggacaggtacgttcactctacacatcagcagcctgctagtctagaagtattttagacttaattttacttacgtgtacagtactaagttaactaaattacgtcggtaccttacgtacttacgtttcggaccgacgggtacctaggtcgtaggacgtaactacgaaacggtaacgtcggtacgtacgtagtaccacgtacg

SEQ ID NO: 69333 - DNA, 553 bp, Homo sapiens
  misc_feature: GYAE6OF02JXOPD.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccagcagaacctggccaggctcccaggcctcctcatctatgatgctatccacgaacgggccactgactactcccagccaggttcagtggcaggtcgggtctgggacaggtacgttccactctacaccatcagcacgcctgctagtctagtagtatttgacttaatttacttacgtgtacgagtactagtaattaacgtacgtcgtaccttaccgttactacgttttacggaccgtacggggacctacggtcgtaggacgtaacgtaaccgaaacgtacgttggtacggtacgtcgactacctacg

SEQ ID NO: 69334 - DNA, 902 bp, Homo sapiens
  misc_feature: GYAE6OF02IN1A8.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtcgtctccgaggggaaanacgcccacccttctcctgccagggccagtcagagtgtagcagcgacttagcctggtaccagacaacgaaacgtcggaccaggcctcccgagcctccctcactcctatagactgacactacccaacgaacgggccctaacgtcggtaacttaaccgtccccgaacggtaccgtaacggtttcgaacggtccgggtacgtaacggggtttcgggtaccggttacgggggaacctaacgggtaccggttttaccctaaccggtttccgtaacccctaacccgtaacgttaccgaaaccgggtacccggtaaccggtccccgttacgggtaaccgttaacggggtttaacccgttaagggttaaaaccggtttaacggttttttaccgggaaaccctttttaaaacgtttttttaaaccgtttaaccgttttacggttaacccggttaaagttaaccggtttaaacggtttaaaactttaaaccgtttaaaccgttacccgggttaaccccgtttaaacccggtttaaaccgtttaacccggggttttttaccgggtaacccgggtaaccggggggttaaaccctacggggtaacccggtttacggggtaaaccggtaaaccgtttaaacccggtaaaaaccgggttacggtttaccggggttaccgggtaacccgtttacgggaaccccgttaacccgttaacccgg

SEQ ID NO: 69335 - DNA, 734 bp, Homo sapiens
  misc_feature: GYAE6OF02IRJOZ.51.76.G10.1.454.CMB.1.raw
tcagcgatcgtatacacgaccggtgctcgatttagtcactcatacaggggaggaactgctcagttaggacccagacggaaccatggaagcccagcgcagcttctcttcctcctgctactctggctcccagataccactggagaagtagtgatgacgcagtctccagccaccctgtctgtgtctccgaggggaaagacgccaccctctcctgcagggccagtcagagtgttagcagcgacttagcctggtaccagcagaacctggccaggcctcccgaggcctcctcactctaatgatgcactccgaacaacggggccaacgttgaacttacctccccgaacgtcccgtaagggtttccaaaggggtttcggaccgtaaggggtttcggggttacctagggggaaacctagtaacggttttcccaaccgttcctacccgaactaacgtaccgaacgtccgaacgtcccgtacggtaccgtacgttaccgttaaggaaacggtttagtttttacggaccgtttaaggtttttaacctttaacgttagttaccgtaaggtaccgtaaacggttaacccgttaaaaccgtaaccgttccgggttaccgtttacccggtttacgttttacccgggggaaccgggtaaccggggtaacccgtaacggggttacgggaaacgtaacgtaccggtaaaacgtacgttgggttcggaccgtgaccgtaacgtcgttcttacgg

SEQ ID NO: 69336 - DNA, 515 bp, Homo sapiens
  misc_feature: GYAE6OF02JIGKP.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaaacctggccaggctcccaggcctcctcatctatgatgcatccacgaagggccactgatactcccagccaggttcagtggctaggtgggtctggggacaggagttcactctacaccatcagcagcctgctacgtctcgtaagtatttgacttaatttattactgtcagctagtataatacgtgcctccgtactacgtttgaccgtagggtaccaggtctaggagtactacgaacgtacgtggtagctacgcctactacg

SEQ ID NO: 69337 - DNA, 562 bp, Homo sapiens
  misc_feature: GYAE6OF02GHFEJ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggcctcctcatctatgatgcatccacgaacggccatgactactcccagcctaggttcagtcggcaggtgggtctgggacaggtagttcactctacacatcacgcacgcctgcgacgtctgaagtagtttagacttaatttattactcgttacagtacgtagttaataataacgtacggttacccttaccgttaaccttacgtttcggaccgtacggggtacctaacggtcgtaggtacggtaactaccgaaacggtacgtggtacggtacgtcgtaccgactacg

SEQ ID NO: 69338 - DNA, 650 bp, Homo sapiens
  misc_feature: GYAE6OF02HLUQA.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctccagccaccctgtctgtgtctaccaggggaaangcccaccctctcctgcagggccagtcagagtgttagcagcgattagcctaggtaccagcaagaaacctggaccaggcctccaggctcctcatctatgatcgcatccaacgaaacgggccagtgaactactaccccagccaaggtttcaaggttggacgtaggttcggggtcctaggggacaggtaagttccaacttcctacacctaatccgaagccaacgtccctggactacgtcgtaggtaagttactttttagacttaaagttttattaacgttgtacctaggtactaagttaataaacgttaacgtacggtacccgttacccgttaacgttaccgttttacgggacccggtacgggggtaacccgtaagggtcccggtagggtaacggtaacttaaaccggaaaaccggttacgtacggttacgggaccttaaggacctaaccgttaaccg

SEQ ID NO: 69339 - DNA, 612 bp, Homo sapiens
  misc_feature: GYAE6OF02ISA4I.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggcctcccaggcctcctcatctatgatgcatccacgaagggccacgtgatactcccagcccgtaggttcaggttcggacgtaggtcgggtcgtaggggacaggtacgttcacttccgtaccacctactccgtacgccacgtccctgtacagtctaggtaagtattttagacttaattttacttacttgtaccagtactaagttaactaaacgtaaccgttcggtcccttaccgttaaccgttacgtttacgggaccgtaacggggtaaccgtaacggtccgtaagggtaacgtactaaccgtaaaccgtaacgttgggtacggtaccgtacggtacccaccgtacg

SEQ ID NO: 69340 - DNA, 532 bp, Homo sapiens
  misc_feature: GYAE6OF02HH7I5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcagtgggtctgggacagagttcactctcacatcagcacgcctgcagtctagaagtatttgactaatttacttactgtctagcaagttataataacgtcgtaccttaccgtactacgtttcgaccgtacggggacctaacggtcgtacggaagtacgtaacgtaaacgaacgtcggtaggtcctacgactacctaacg

SEQ ID NO: 69341 - DNA, 605 bp, Homo sapiens
  misc_feature: GYAE6OF02HNF6K.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangcccaccctctcctgcagggccagtcagagtgttagcagcgacttagcctggtaccagcaagaaacctggccaggcctcccgaggcctcctcatctatgatgcactccacgaagggcccactgaatactcccgagcctaggttcaggtggctaggtgggtctgggacagacgttcactcctcaccatccagcagcctgctagtctagtaagttattttagacttaagtttactttacgttgtacgtacgtacgtaagttaataaacgttaacgtcggtacccttaccgttaaccgttaccgttttacgggacccggtacggggtaacccgtaacggtccggtagggtaacgtaacgtaaccgtaaaccggtaacgttcggtacggtacgtacggtaccgtaaccgtacg

SEQ ID NO: 69342 - DNA, 510 bp, Homo sapiens
  misc_feature: GYAE6OF02H1FSO.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggcctcctcatctatgatgcatccacaaggccactgatatcccagcctaggtcagtggcagtggtctgggacagagttcactctacacatcagcagctgcagtctagaatatttgactaatttattactgtacagacaagtataataactgtccttcgtactacgtttcggcctacggggaccaaggcgtaggagactaaccgaaacgtacgtggtaggactacggaccacctac

SEQ ID NO: 69343 - DNA, 582 bp, Homo sapiens
  misc_feature: GYAE6OF02J1D9A.51.76.G10.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacaggggaggaactgctcagttaggacccagacggaaccatggaagcccagcgcagcttctcttcctcctgctactctggctcccagactaccactggagaagtagtgatgacgcagtctccagccaccctgtctgtgtctccgaggggaanacgccaccctctcctgcagggccagtcagagtgttagcagcgacttagcctggtaccngcagaacctggccaggctccgagctccnatctatcgatgcactccacgaaacgggccctaagtgaacttacacccagtcccaggttccaggtggcctagggtcggttcgagggactagtacgtttcaccgtcttaccgaccgtacgtaccacgaccacgtacccgtgtaccgtacgttacgtagtaaacgttgtttacgtaccttaattttacgttactgtacagtactaagtacttaagtacgtcgtaccttacgtacttacgtttacgcgtacggactagtcgtaggagtactacgaacgtacgtagtagtcgtacgtactactacg

SEQ ID NO: 69344 - DNA, 523 bp, Homo sapiens
  misc_feature: GYAE6OF02ILHIG.51.76.G10.1.454.CMB.1.raw
  modified_base (197)..(197): a, c, t, g, unknown or other
  misc_feature (197)..(197): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (394)..(394): a, c, t, g, unknown or other
  misc_feature (394)..(394): n is a, c, g, or t
  modified_base (412)..(412): a, c, t, g, unknown or other
  misc_feature (412)..(412): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccaggggaaancgcccaccctctcctgccagggccagtcagagtgttagcagcgacttagcctggtaccagcagaacctggccaggctcccgaggcctcctnatctatgatgcatccanaagggccagtgatactcccagccaggttcagtggacaggtggctgggacagtcgttcacgtctacgaccatcagcacgcctgcagtcgngaatagtttgctaatttntactgtcagcagtataatactgtacctcgtactacgtttgaccgagggtacctagccgtaggtacgtaactacgaaacgtaccgtagtacggtctacgtaccgacctaacg

SEQ ID NO: 69345 - DNA, 507 bp, Homo sapiens
  misc_feature: GYAE6OF02FL9HU.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaacctggccaggctcccaggctcctcatctatgatgcatccacaagggccactgatatcccagccaggttcagtggcagtgggtctgggacagagttcactctcaccatcagcagcctgcagtctgaagtattttgctaatttattactgtctagctagtataattaactcggtaccttccgtactacgttttcggccgtagggaccaacggcgtggacgtatacgaaacgactaggtcggctcgccactac

SEQ ID NO: 69346 - DNA, 535 bp, Homo sapiens
  misc_feature: GYAE6OF02IDOYS.51.76.G10.1.454.CMB.1.raw
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctccaggctcctcatctatgatgcatccacaagggccactgatactcccagccaggttcaggtgcagtgggtctgggacagngttcactctcactatcagcagcctgcagtctgaatntttgactaattttattactgtacagactagtaataataactcggtacccttccggtaactacgttttcggaccgtacgggggacctaaggcttagggacgtaacttaaccgaaacgtacgtaggtacggactaggacctaccttacg

SEQ ID NO: 69347 - DNA, 510 bp, Homo sapiens
  misc_feature: GYAE6OF02IFHZ4.51.76.G10.1.454.CMB.1.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
  modified_base (402)..(402): a, c, t, g, unknown or other
  misc_feature (402)..(402): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggcctcccaggctcctcatctatgatgcatccacaagggccactgatatcccagccagttcagtgcagtggctgggacagngtcactctcaccatcagcagcctgcagtctgagtatttagactatttattactntcagcagtactaataacgtgaccttcgtactcgtttacggccgtacgggaccaggtcgtacggagtacgtacgaaacgtacgtaggtacggacgtcggacctactacg

SEQ ID NO: 69348 - DNA, 566 bp, Homo sapiens
  misc_feature: GYAE6OF02HG8KY.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacgaacgggccactgactactcccagccaggttcagtggcaggtggtctgggacagtagttcactctcaccatcagcagcctgcagtctagtaatatttgacttaatttattactgtactagtactaagtaataataacgttcggtacccttaccgttacttaccgtttacggtaccggtacgggtaccggtaacggtacggtacggaggtaacgtaaccgtaaaccggtaacgttacggtacggtaccgtacgtaccgtaccgtacg

SEQ ID NO: 69349 - DNA, 540 bp, Homo sapiens
  misc_feature: GYAE6OF02IJI1W.51.76.G10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
  modified_base (317)..(317): a, c, t, g, unknown or other
  misc_feature (317)..(317): n is a, c, g, or t
  modified_base (371)..(371): a, c, t, g, unknown or other
  misc_feature (371)..(371): n is a, c, g, or t
  modified_base (420)..(420): a, c, t, g, unknown or other
  misc_feature (420)..(420): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggcctcccaggctccncatctatgatgcatccacaaggccactgatacncccagccaggttcagtggcaggtggtctgggacagtagttccactctcacctancagcagcctgcagtctagaatagtttgactaatttacttactgtcagtntaagtataataacgtgtcccttacgtaccttacgtttcggaccgtacggggaacctaaggtccgtaggacgtaacgtaaccgaaaaccgtacgtaggttacgacgtacgtccaccgtacg

SEQ ID NO: 69350 - DNA, 597 bp, Homo sapiens
  misc_feature: GYAE6OF02GUO0A.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccacctctcctgcagggccagtcagagtgttagcagcgacttagcctggtaccagcagaaacctggccaggcctacccaggcctcctcatcctatgatcgcagtcccacgaacggggcccacgtgaactacgtcccagccaggttccagtggcaggtgggtcgtggacagagttcactctcaccatcagcagccgtgctagtcctagaacgttagttttagaccttaatttacttaacgttgttacgtagtactaagttataaacgttaactcggtacccttaccgtaaccttacgtttcgggcccgtaggggtacccaaggtccgtacgggtaagtacgttaaccgtaaaccggtaacgtttacgggttacggtacctacggtaccgtacccttaacg

SEQ ID NO: 69351 - DNA, 484 bp, Homo sapiens
  misc_feature: GYAE6OF02FI9QD.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagaattcactctcaccatcaccagactagagcctgaagattttgctagtttattactgtcagcagcgtaacactggctcttcttcggcggagggaccaggtgagatcgaacgaactgtgctgcaccatctgtctc

SEQ ID NO: 69352 - DNA, 579 bp, Homo sapiens
  misc_feature: GYAE6OF02F1MKM.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggcctcctcatctatggatcgcactaccaacgaacgggcctacgtgactactcccagtccaggttcaggtcggcgtaggtggggtactgggaactagtagttccacttcctacaccatcagccagcctgctagtacgtagtaagtattttagacttaatttagttactagtcaagtctaagttaataacgttaaccgtcggtaccttaccgtacgttaccgtttagggaccgagggtaccaaggtacgtaacggtacgtaacgtaccgaaaggtacgttacggtacggactacgtactacgtacg

SEQ ID NO: 69353 - DNA, 617 bp, Homo sapiens
  misc_feature: GYAE6OF02GDE2N.51.76.G10.1.454.CMB.1.raw
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagtttaagagtgatgacgcagtctccagccaccctgtctgtgtctccaggggaaanagccacctctctgcagggccagtcagngtgtagcagcgacttagcctggtaccagcagaaacctggaccaggcctccgacggtctcctcattccgtatgattgacatccaacaacgggcccagtgactatcccgagcccaggttcagtggcaggtgggtctgggaccaggtacgttcaacgttctacgaccatcgacgcacgcctgtacgagttctacgaagttatttggaccttaattttacttacgttgtcgaacgtcgtaaagttactaaaattaaccgtacgggtaccctttaccggttaaaccttacggtttttacggaccgttaacgggggtaaccctacggtacggtacggtaacggtaacttaacgaaaacggtaacttcgggttacggtacctgggtacccaccttaacgg

SEQ ID NO: 69354 - DNA, 648 bp, Homo sapiens
  misc_feature: GYAE6OF02G6UBI.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcgagggccagtcagagtgttagcagcgacttagcctggtaccagccaagaaccgtggaccaggcctcccgaggcctcctcatctatgatcgacactccaacgtaacgggccacgtgatacctcccgagtcctaggttcaaggtcggacctaagggttcgggtacctggggaactaggtacggtttccaaccgttcctaccgaacctactaccgacgccgtacgtcccgtcgaccgtacggtacgtacgtaagttattttcggacttaagttttacgttacgttgtacacgtacgtaagttaacgtaaattacgtcggtacccttaccgtacttaacgtttcggacccgtacgggtaacctaacggtccgttacggaacgtaaccgtaaccgaaccgttaacgttcggtaccggtcctacggtacctacccgtacg

SEQ ID NO: 69355 - DNA, 496 bp, Homo sapiens
  misc_feature: GYAE6OF02I9NDM.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctggggacaggagttcacgtctcaccatcagcagcctgcagtctgaagtatttgactaatttattactgtacagctagtataataactgcctcgtactactttggcctagggaccaaggctaggagactacgaacgactgtgctagctactacg

SEQ ID NO: 69356 - DNA, 515 bp, Homo sapiens
  misc_feature: GYAE6OF02GBMSR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtagcagcgacttagcctggtaccagcagaaacctggccaggctcccaggctcctcatctatgatgcatccacaagggccactgactatcccagccaggttcagtggcaggtgggtctgggacagacgttcactctcaccatcagcagcctgcagtctagaagtatttagctaatttattactgtcagtcagtataataacgtcggtacctccgtactacgtttcggaccgtacgggtaccaaggtcgtacggagacgtacgaacgtaactggtaggctgccacctacg

SEQ ID NO: 69357 - DNA, 558 bp, Homo sapiens
  misc_feature: GYAE6OF02I1BQS.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggcctcccaggcctcctcatctatgatgcatccaacgaacgggccactgatactcccagccaggttcagtcggcaggtgggtctggggacaggtacgttcactcgtacaccatcagcacgcctgcagtctagaagtatttgacttaattttattacttgtctagactaagttataaataacgtacgtacccttccgtacttacgttttacggaccgtacggggtaccaaggtcgtagggaagtaacgttaaccgaaacgtaacgtcggtaggtacgtacggccacctacg

SEQ ID NO: 69358 - DNA, 553 bp, Homo sapiens
  misc_feature: GYAE6OF02G5MP3.51.76.G10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccacctntcctgcagggccagtcagagtgttagcagcgacttagcctggtaccagcagaacctggccaggctcccaggctcctnatctatgatgcatccacgaagggccagtgatactcccagccagttcagtgcaggtggtctgggacagtattcgactctacaccatcagcagcctgctagtcgtagtaagtatttacgacttaatttattactagtctagtactaagttataatacgtacggtaccttaccgtactaccgttttacgggaccgtacggggtaccaacggtcgttacgggaacgtaagtaaccgaaacgtaccgttggtacgtaccgtacgtaccgaccgtacg

SEQ ID NO: 69359 - DNA, 614 bp, Homo sapiens
  misc_feature: GYAE6OF02ICG0O.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgacttagcctggtaccagcaagaaacctggccaggcctcccgaggcctcctcatctatgatgcatccacgaagggccatgatactcccagcctaggttccaggtcggcgtaggtcggggtctaggggacaggtacgttccacttctccacctatcacgcagcctgcagtctagtaagttatttgtacttaattttacttactgtactagtactaagttataaagttaacgttcggtacccttaccgttacgttaccgttttacgggaccggtaacggggtaaccctaacggtcggttaacgggtaacggtaaccgttaaccgaaaaccggttaacgttacgggttacgggtaccgttacggaccctaccgttaccg

SEQ ID NO: 69360 - DNA, 509 bp, Homo sapiens
  misc_feature: GYAE6OF02G93MI.51.76.G10.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcagaacctggccaggctccaggctcctcatctatgatgcatccacaagggccactgatacncccagcctaggttcagtggcaggtggtctgggacngagttcatctcacatcagcagcctgcagtcgtagaagtatttgacttaatttattactgtacagactagtataatacgtgtcccttcgtactacgtttcggacctagggaccaggtcgtaggagaactacgaaacgacgtcgtaggctacgacactac

SEQ ID NO: 69361 - DNA, 574 bp, Homo sapiens
  misc_feature: GYAE6OF02FVZ94.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaacgggccaatgatactcccagccaggttcagtggcaggtgggtctgggacagagttcactctcaccatcagcagcctgcagtctagtaagtattttgacttaatttattacttgtacagtctagttaataaattaacgttacggtacccttaccgttaccttaaccgtttttacggacccggtacggggtaacccgaaggtccgttagggtaacggtaacgttaccgaaaaccggtaacgtacggtcggtaccgttacggacctacctaaccg

SEQ ID NO: 69362 - DNA, 550 bp, Homo sapiens
  misc_feature: GYAE6OF02IW0TU.51.76.G10.1.454.CMB.1.raw
  modified_base (197)..(197): a, c, t, g, unknown or other
  misc_feature (197)..(197): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
  modified_base (432)..(432): a, c, t, g, unknown or other
  misc_feature (432)..(432): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggcccaggcctcccaggctcctcatctatgatgcatccanaagggccatgatactcccanccgaggttcagtcggacaggtggtctgggacagtacgttcacctcnccaccatacagcacgcctgcagtctagtaagttattttagacttaaatttattaactgtacngtactaagttataaatactgtccttacgtacttaccgtttcggaccgacgggtactaggacgtacggaagtacgtaccgaaaagtacgttaggtcgtacgtacgtacctaaccgtacg

SEQ ID NO: 69363 - DNA, 571 bp, Homo sapiens
  misc_feature: GYAE6OF02HZDO0.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctcactctatgatgcatccacaacgggccactgactactcccacgccacggttcagtggcaaaggtgggtcgtgggacgagtagttcactctcaccatcagcgacgcctgcagtctagtaagtatttgtactaattttattactgtctagtctaagttaataaattaacgttcggtaccttaccgttacgttaccgttttacggaccgtacggggtaccgtaacggtacgtacggtacgaacgtaacgtaaaccgtacgtacggtaggtacgtcgtacctaccttaccg

SEQ ID NO: 69364 - DNA, 532 bp, Homo sapiens
  misc_feature: GYAE6OF02G9U9D.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccaacgaaggccactgatactcccagccaggttcagtgcagtggtctgggacagagttcactctcaccatcagcagcctgcagtctgaagtatttgactaatttattaactgtcagactagtaataataactggtacccttaccgtactacgttttcggaccgtaggggacctaaggtctaggaacgaagtacgaaaacggtaacgttggtacggtctacggacctaaccgtacg

SEQ ID NO: 69365 - DNA, 697 bp, Homo sapiens
  misc_feature: GYAE6OF02H8V2Q.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagagtgttagcagcgacttagccttggtaccagcagaaacctggccaggcctcccaggcctcctcatctatgatgcatccacgaacgggccacgtgatactcccagcctaggttcagtgggcaggttcgggtctaggggactaggtacgtttccgacttccgttaccacctagttccgacgtccgtaagttccgttaggcgtacgttccgttaggtaaacggttacgttttttacggaacctttaaatttttacgttttaaccgttagttaccgtaagtaccgttaaggtttaaacttaaacgtttaaaccgttaccgggttacccgttacccggtttaacctttaaccggtttttaccggggacccgttaacgggggtaaccctaacgggtccggttaacgggacggtaaccgttaaccgaaaccggtacgttacggttacggtacccgttacggtacccgtaccgttaaccg

SEQ ID NO: 69366 - DNA, 601 bp, Homo sapiens
  misc_feature: GYAE6OF02HONMT.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgattagcctggtaccagcagaaacctggccaggctcccaggctcctcatctatgatgcatccacaagggccactgatactcccagccaggttcagtggcagtgggtctgggacaggtactcactcgtacaccatacacgcacgcctgaccgtagtctaaggtaaagtttgttttacggaactttaaagttttaccttacgtttacgtacgtaacgtaccgttaaagttaacttaaagttaaccggttcggttacccgttaccgttaacgtttaccggttttacggaccggtacgggtaccaacggtcgtaggaacgtaactaaccgtaaacgtacgtaggtaccggtcgttacgaccgtactacg

SEQ ID NO: 69367 - DNA, 491 bp, Homo sapiens
  misc_feature: GYAE6OF02HQDB0.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcacgcctgcagtctagagtatttgactaatttattactgtcagcagtataataactcgcctccgtactactttcgcgagggactagcgtggagatacgaacgtactggtgtctcgcactacg

SEQ ID NO: 69368 - DNA, 516 bp, Homo sapiens
  misc_feature: GYAE6OF02IG29L.51.76.G10.1.454.CMB.1.raw
  modified_base (317)..(317): a, c, t, g, unknown or other
  misc_feature (317)..(317): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
tcagcgatcgtatacacgaccggtgctcgatttagtcactcatacaggggaggaactgctcagttaggacccagacggaaccatggaagcccagcgcagcttctcttcctcctgctactctggctccagataccactggagaagtagtgatgacgcagtctccagccaccctgtctgtgtctccaggggaaagacgccaccctctcctgcagggccagtcagagtgttagcagcgattagcctggtaccagcagaaacctggccaggcctcccaggctcctcatctatgatgcatccacgaagggccaactgactancccagccaggttcagtggcagtggtcngggacagtagttcanctcaacatcagcagcctagcagtctagtaagacttttagctaaatttattactgttacagtcaagtataataaacgtgtcctccgtatacttttcggacctaggggaaccaagtcgtaggtagtataacaaacgaactcggagcgtagacgactacg

SEQ ID NO: 69369 - DNA, 522 bp, Homo sapiens
  misc_feature: GYAE6OF02F9SWO.51.76.G10.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttcagtggcagtgggtctgggacagngttcactctcaccatcagcagcctgcagtctgaagtatttgacttaatttacttactgtcagctagtataataacgtgtcctaccgtactacgtttcggccgtaggggacccaaggtcgtagggacgtaacgtaccgaaacgtacgtaggtcggactcggaccacctacg

SEQ ID NO: 69370 - DNA, 562 bp, Homo sapiens
  misc_feature: GYAE6OF02GVHPV.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcagtgggtctgggacagagttcactctcaccatcagcagcctgcagtctgaagtattttgactaatttattactgtcagtcaagttataaattaaccgttacggtacccttaccggtaaccttaacgttttcgggacccgtacggggtacccgtaacggtcgtagggtaacgtaacgttaccgaaacgtaacgtaggttacggtaccgttacggacctaccgtaacg

SEQ ID NO: 69371 - DNA, 573 bp, Homo sapiens
  misc_feature: GYAE6OF02G1KUP.51.76.G10.1.454.CMB.1.raw
  modified_base (390)..(390): a, c, t, g, unknown or other
  misc_feature (390)..(390): n is a, c, g, or t
  modified_base (432)..(432): a, c, t, g, unknown or other
  misc_feature (432)..(432): n is a, c, g, or t
tcagcgatcgtatacacgaccggtgctcgatttagtcactcatacagggggagggaactgctcagttaggaccccagacggaaccatggaagccccagcgcagcttctcttcctcctgctactctggctcccagataccactggagaagtagtgatgacgcagtctccagccaccctgtctgtgtctcgaggggaaagagccacctctcctgcagggccagtcagagtgttagcagcgacttagcctggtaccagcaagaaacctggcccaggctcccaggcctcctcatctatgatgcatccacaagggccatgactactcccagcctaggttcagtggcaggtgggtctgggactagtagttcactccgtacaccatcagcacgcctnctagtctagaacgttatttgacttaagttttatacttcgtanacgtactaagttaattaacgtaactcgtaccttaccgttaacttacgtttcggaccgtacggggaacctaacgggtcttacggaagtacgaacccgtaaaagtaacggttacggtacggtacgtacgtaccgtacttaacg

SEQ ID NO: 69372 - DNA, 570 bp, Homo sapiens
  misc_feature: GYAE6OF02GPHH9.51.76.G10.1.454.CMB.1.raw
  modified_base (366)..(366): a, c, t, g, unknown or other
  misc_feature (366)..(366): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgttagcagcgacttagcctggtaccagcagaacctggccaggctcccaggctcctcatctatgatgcatccaacgaagggccactgatatcccagccaggttcaggtggcaggtgggtctgggacagagttcatttcncaccatcagcacgcctgcagtctgaagtattttgacttaatttattactgttacagtactagttaataacgtaacgttacggtaccttaccgttacttaccgttttcgggaccgtacggggtaccgtaacggcggttacggtacggtaacgttaaccgtaaacggtaaccgttaggttacgggtactacggtaccgtacctacg

SEQ ID NO: 69373 - DNA, 524 bp, Homo sapiens
  misc_feature: GYAE6OF02H170V.51.76.G10.1.454.CMB.1.raw
  modified_base (195)..(195): a, c, t, g, unknown or other
  misc_feature (195)..(195): n is a, c, g, or t
  modified_base (334)..(334): a, c, t, g, unknown or other
  misc_feature (334)..(334): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcnggtggtctgggacagagttcactctcaccatcagcagcctgcagtctgaagtatttgacttaatttattactgtacagtacaagtataataactcggtaccttaccgtactacgttttcggaccgtaggggacctaaggcgttagggagtaacgtacgaaacgtacgtcggtacggactcgaccactacg

SEQ ID NO: 69374 - DNA, 570 bp, Homo sapiens
  misc_feature: GYAE6OF02JF584.51.76.G10.1.454.CMB.1.raw
  modified_base (205)..(205): a, c, t, g, unknown or other
  misc_feature (205)..(205): n is a, c, g, or t
  modified_base (333)..(333): a, c, t, g, unknown or other
  misc_feature (333)..(333): n is a, c, g, or t
  modified_base (400)..(400): a, c, t, g, unknown or other
  misc_feature (400)..(400): n is a, c, g, or t
tcagcgatcgtatacacgaccggtgctcgatttagtcactcatacgacggggaggaactgctcagttaggaccctagacggaaccatggaagccccagcgcagcttctcttcctcctgctactctgggctcccgagataccactgggtagaagttagtgattagacgcagtctccagccaccctgtctgtgtctccgaggggaanagccaccctctccgtgcagggccagtcagagtgttagcagcgacttagcctggtaccagcagaaacctggccaggcctcccgaggcctcctcagtcgtatgatcgcatccacgaagggccatgatacnccagctagtcagtcgcaggtgggtctggacacgacgttcactctacaccatacagcagcctgcagtntagaagtatttgactaatttatacgtgtacagtctagttacttaaatacgtcggtccttaccgtaacttacgttttcgggaccctaggggaacctaacggtcgttagggaactaccgttaacgtaaaacggtcgttacggtacggtaccgtacggtacctaccgttaacg

SEQ ID NO: 69375 - DNA, 606 bp, Homo sapiens
  misc_feature: GYAE6OF02H2L6B.51.76.G10.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (281)..(281): a, c, t, g, unknown or other
  misc_feature (281)..(281): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacaggggaggaactgctcagttaggacccagacggaaccatggaagccccagcgcagcttcctcttcctcctgctactctggctcccagataccactggagaagtagtgatgacgcagtctccagcccaccctgtctgtgtctccaggggaaangccacctctcctgccagggccagtcagngtgtagcagcgattgcctggtaccagcagaaacctggccaggctcccaggctcctnatctatcgatgcactccacaagggtccaactgaatacncccagccaaggtttccagtggctaggtgggtctgggacagagttccatctaccgacatcacgcacgcctgcacgtcgtagaacgtacgttttcgtacttaattttacgtttacttacgtacctaagaccgttaagttaacttaaacttaaacgttacggtaccttacccggttaacttaaccgtttttcggacccgttaacggggaacccgtaacggtcgttacgggaagtaacgttaaccgaaacggtaacgttacggtaggtaccgtacgtacctaccgttaacg

SEQ ID NO: 69376 - DNA, 750 bp, Homo sapiens
  misc_feature: GYAE6OF02GENK0.51.76.G10.1.454.CMB.1.raw
  modified_base (202)..(202): a, c, t, g, unknown or other
  misc_feature (202)..(202): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccactggaagaagtagtgatgacgcagtcctccacgcccacccgtgtctgtgtcctcgaagggaancgccaccctctcctgcgacgggccagtcagagtgtagcagcgtacttacgccgttaggtaacccagaccgaaacgtaaaccgtcggacccgaacgggccccttaccccggaaggtcccttcccctacgtacttaccttaagtcggtaattcggacctactacccgaaacggaacggggccctaacgtagtaacttaaccgaccccgacgtacccgtaaggttccgaagggtcggaccgtagggtttcgggcggtaggactaggtacttaccacttccgtaccaacctataccgacgtccgaccgtcctacggacctacggttacgtaaggtaagttttacgttttaacgacttttaaactttacgtttaacgttgtacgaacgtactaaagtttaactttaaacgtaaccggttaccgttacccgttacccgtttaacgtttaccggtttacggaacccgggtacggtaaccgtaacggtcggtaagaacgtaaccgttaacggtaaaacgttcgttacggtacgaccgttacggacctacgttaccg

SEQ ID NO: 69377 - DNA, 496 bp, Homo sapiens
  misc_feature: GYAE6OF02FFCU5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtgggtctgggacagagttcactctcaccatcagcagcctgcagtctgaagtatttgctaatttattactgtcagcagtataataactgtcctccgtactcttttcggcctagggaccaaggtctggagactacaaacgtacgtggtacggctcgcactac

SEQ ID NO: 69378 - DNA, 515 bp, Homo sapiens
  misc_feature: GYAE6OF02FL4SB.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagccaggttcagtggcaggtggtctgggacaggagttcactctcaccatcagcagcctgcagtctgaagtatttgacttaatttattactgtcagtcagttataataactcgtccttaccgtactacgtttggccgtaggggaccaacggctaggagtataccgaaacgtaacgtggtacggctcggacacctac

SEQ ID NO: 69379 - DNA, 562 bp, Homo sapiens
  misc_feature: GYAE6OF02JGRSS.51.76.G10.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctcncctgcagggccagtcagagtgttagcagcgacttagcctggtaccagcagaaacctggccaggctcccaggctcctcatctatgatgcatccacaagggccactgactatcccagccaggttcagtgcagtggtctgggacagacgttcactcgtcaccatcagcacgcctgcagtctagaagtatttgactaatttattacttagtacagtctaagtactaacttaacgtcggtacccttaccgtaacttaccgttttacggaccgtacggggtaaccgtaacggtcgtaggaacgtaacgttaaccgtaaaccggtaacgttacggtcggtacgtacggtacctaccgtaacg

SEQ ID NO: 69380 - DNA, 536 bp, Homo sapiens
  misc_feature: GYAE6OF02IFQKR.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaacctggccaggctcccaggctcctcatctatgatgcatccacgaacgggccactgactactcccagccaggttcagtggctaggtgggtcgtggggacagtagttcactctcacatcagcagcctgcagtctagaagtattttagacttaatttattactgtacagtactaagtataattacgtggtacccttcgtactacgtttacgccgacggggtacctaaggctaggaagtactacgtaaacgacgttggtacggtctacggacctacgtacg

SEQ ID NO: 69381 - DNA, 594 bp, Homo sapiens
  misc_feature: GYAE6OF02HF7QG.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaanagccaccctctcctgcagggccagtcagagtgttagcagcgacttagcctggtaccagcagaacctggccaggctcccgaggctcctcatctatgatgcatccacgaacgggccactgatactcccagccctaggttcaggtggcaggtcgggtcgtgggacaggacgttccacttctacaccatccacgacacgtcctgcgtacgtcgtagtaagttattttgtacttaattttattacgttgtacagtactaagtaattaacttaacgttcggtacccttacccggttaacttacgttttcgggacccgtacggggtaaccctaacggtcgttacggtacgtaacgtaaccgtaaaccggtaacgtcgggttacggcgtacggtacctaccgtacg

SEQ ID NO: 69382 - DNA, 541 bp, Homo sapiens
  misc_feature: GYAE6OF02G77XU.51.76.G10.1.454.CMB.1.raw
  modified_base (384)..(384): a, c, t, g, unknown or other
  misc_feature (384)..(384): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggcctccccaggcctcctcatctatgatgcatccacaagggccactgatactcccagccaggttcagtggcaggtgggtctgggacagagttcactctcaccatcagcagcttgcngtctgaagtattttgcttaattttattacttgtactagctaagttataaattaacgtcgtccttaccgtactacgttttcgggacccgtaggggtacctaggtcgtaggtacgtagtaccgaaacgtacgttggtacggtcgtcgtaccaccgtacg

SEQ ID NO: 69383 - DNA, 776 bp, Homo sapiens
  misc_feature: GYAE6OF02HO0WD.51.76.G10.1.454.CMB.1.raw
  modified_base (207)..(207): a, c, t, g, unknown or other
  misc_feature (207)..(207): n is a, c, g, or t
tcagcgatcgtatacacgaccggtgctcgatttagtcactcatacagggggaggaactgctcagttaggacccagacggaaccatcggaagccccagaccgcagcttcctcttcctcctcgctacgtctggcctcccgagataccactggtagaagtagtgatgaccgcagtctccagcccaccgtgtctgtgtctccgaggggaanggccacctcgtcctagcgacgggccagtcgagtagtgttacgcagacgacttagccgtaggtaccacgtcaacggaaaccgtcggaccacggcctacccgagggcctcctcacgtccctagtcgaagtcgacaacgtccgaacgtaacggggccctacggttagtaacttaccgtacccgaacggtccggtacggttcccaaggttacggtcgtagggtacgggtacgtagggggtaactacggggtacgtttaccgacctttcgtaccctaaccgtacgttaccggaacgtaccgtaaccgtccgtacgtaccgtaacgtacgttaaggtaaacgttacgtttacgtacgttaaacgttttacgttacgttacgtacgtaacgtacgtaaacgttaacgttaaaccgttacgttaccgttacccgttaccgttaccgttaccggttttaccggacccggtaacggggtaaccggtaacggtaccggtacgggaacggtaaccggtaaccgttaaaccggttaacggttacgggtacgtaccggtaccggtacccgtacccgttaacgg

SEQ ID NO: 69384 - DNA, 585 bp, Homo sapiens
  misc_feature: GYAE6OF02JMXSW.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggaggaactgctcagttaggacccagacggaaccatggaagccccagcgcagcttctcttcctcctgctactctggctcccagactaccactggagaagtagtgatgacgcagtctccagccaccctgtctgtgtctccaggggaaanacgccaccctctcctgcagggccagtcagagtgttagcagcgtacttagcctggtaccagcagaaacctggaccaggcctcccaggcctcctcactctatgatcgctatccacgacgggccacgtgactactcccgaagtcccgtaaggttccaacggttggcctaagggttcgggtcgtaggggaccaggtacgttcaccgttcctcaccactacacgtcacgcctcgcgagtctagacgtatttcgtacttacgtttacttactgtacgtatcgtaacgtattaataaccgttacgtaccgttaccgtacttacgtttcggaccgtaggtaccgacgtcgtagagtacgtacgaacgtacgtcgtacggtacgtacgtactacgtacg

SEQ ID NO: 69385 - DNA, 567 bp, Homo sapiens
  misc_feature: GYAE6OF02GRUMP.51.76.G10.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacaggggaggaaatgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctnatctatgatgcatccacaacgggccactgatactcccagccaggttcagtggcaggtgggtctgggacagtagttcactctcaccatcagcagcctgcagtctagaagttagtttgacttaatttattacttgtacagtactaagttaataacttaacgttcggtacccttaccgttactacgttttacgggaccgtacggggtaacctaacggtcgtacgggaacgtacgtaaccgtaaacggtaacgttcgggtacggtacgtacggtaccctaccgttacg

SEQ ID NO: 69386 - DNA, 492 bp, Homo sapiens
  misc_feature: GYAE6OF02G538W.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgccagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcacatcagcagcctgcagtctgaagtatttgactaatttattactgtcagcagtataatactgtcctcgtactactttggccaggggaccaggctaggagagtacaacgtacgtgtaggctgaccactac

SEQ ID NO: 69387 - DNA, 546 bp, Homo sapiens
  misc_feature: GYAE6OF02JJRNX.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttgcctaggtaccagcagaacctggaccaggcctcccgaggctcctcatctatgatcgcatccaacgagggccactgatactcccagcaggttcagtggctaggtggtctgggacaggtacgttcactctacaccatccagcacgcctcgctagtctagaagtatttcgacttaatttattacttgtacacgtctaagtaataagttaacgtcgtaccttaccgttactacgtttacggaccgtacggggacctaaggtcgtaggacgtacgtacgaaacgtacgtggtacggctacgactacgtacg

SEQ ID NO: 69388 - DNA, 598 bp, Homo sapiens
  misc_feature: GYAE6OF02G6HJK.51.76.G10.1.454.CMB.1.raw
  modified_base (196)..(196): a, c, t, g, unknown or other
  misc_feature (196)..(196): n is a, c, g, or t
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggccaggcctcccaggctcctnatctatgatgcactccaacgaagggccactgatactcccagccaggttcagtgcaggtggtctgggacngagttcactctacacatcagcacgctgacagtctagtaagtatttgacttaatttacttacttgtactagactaaggttaataacttaacgtacggttacccttaccgttaaccgttaccgttttacgggacccggtacggggtaacccgtaacggtaccggttacgggtaacggtaacgttaaccgtaaaacggtaaccgtttacgggttacgggtaccgttacggtaccgtacccttacgg

SEQ ID NO: 69389 - DNA, 650 bp, Homo sapiens
  misc_feature: GYAE6OF02JRAFW.51.76.G10.1.454.CMB.1.raw
  modified_base (196)..(196): a, c, t, g, unknown or other
  misc_feature (196)..(196): n is a, c, g, or t
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtccagagtgttagcagcgacttagcctaggtaccaggcagaaacctggaccaggcctcccgaggtcctccgtacactccgtatggaacttcgaccagtaccccgaagaaacggggccctaaacgttgaacttaacctccccgaagtacccgtaagggtttccaaaggttcgggacctagggtttacggggtcctagggggtaacacggtaacgtttccaactccgtactaccgactcgacncgaacgcgtnacgtagtactgaaagtctttacgacttaatttattaacgtntacagtntaagtaataagtaacttaggaccttaccgtacttaacgtttcgaaccggtagggtaaccgtaacggtgttacggtaagtaaccgtaacgtaaacggtacgttggtaccggacgttcgacgtacccttaagg

SEQ ID NO: 69390 - DNA, 670 bp, Homo sapiens
  misc_feature: GYAE6OF02H86Z5.51.76.G10.1.454.CMB.1.raw
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaanacgcctaccctctcctgcagggcctagtcagagtgtagcagcgattagcctggtaccngcagaaacctggaccaggcctcccgaggcctcctcactctatcgatcgcactccaagaacgggccaacgttnactacncccgacgaccgtaggttacacggtcggnaacgggttgggtacctaggggaccaggtacgtttcaccttctaccgaccacttaccgaggaccacgtcccgtaggtacctacggtccttaggtaacgttacgttttacggtacttaacgttttaacttaccgtttacgtaccgtaaggttaccgtaaagttaacgtaaacgttaacgttacggtacccttaccgttaaacttacccgtttttagggacccggtaacgggtaaccgtaacggtacggtaacgggtacgtaacgtaaccgtaaacgtacgtacgggtcgtacggtactaccggtactacg

SEQ ID NO: 69391 - DNA, 608 bp, Homo sapiens
  misc_feature: GYAE6OF02I9GJ1.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcaagaacctggccaggcctcccgaggctcctcatctatgatcgcatccacgaacgggtcccacgtgatactcccaggcctaggttccaggtggccagtcgggtctgggacaggagtttccacgtcctacaccgtatcgagcacggccctagctagtctaggaagttagtttacgacttaagtttacttacttgtactagtctaagttataaacgttaacgtcgtacccttaccgtaaccgttacgttttaccggaccggtaacgggtaaccgtaagggtaccggttagggtaactaacgttacgtaaaaccggtacgttagggtaccggtacgtacggtaccgtaaccgtacg

SEQ ID NO: 69392 - DNA, 597 bp, Homo sapiens
  misc_feature: GYAE6OF02IM452.51.76.G10.1.454.CMB.1.raw
  modified_base (199)..(199): a, c, t, g, unknown or other
  misc_feature (199)..(199): n is a, c, g, or t
  modified_base (233)..(233): a, c, t, g, unknown or other
  misc_feature (233)..(233): n is a, c, g, or t
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaagggggaaanacgcccacccttctcctgccagggcccagtcagngtgtagcagcgacttagcctggtaccagcagaaacctggccaggcnccaggctccncactctatgatcgacatcccaagaacgggccaacgtcgaatacgtcccacgccaggttccagtggctacggtggtcgtagggacagtacgttccacgtctacacccgtatccgaagccacgctcgctagtccagtattatttgacttatttacgttattcgtcagacttaggtaactaacgttaacttcggtacccttaccgttactacgttttacggaccggtacgggacctaacggtcgttacggaacggttactaaccgtaaccggtaacgttcggtacggtacctaccggacctaaccgttcgg

SEQ ID NO: 69393 - DNA, 538 bp, Homo sapiens
  misc_feature: GYAE6OF02IQDEJ.51.76.G10.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
  modified_base (415)..(415): a, c, t, g, unknown or other
  misc_feature (415)..(415): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanacgccaccctntcctgccagggccagtcagagtgttagcagcacttagcctggtaccagcagaacctggccaggctcccaggcctccncatctatgatgcatccaacgaaggccactgatactccagccagttcaggtgcaggtggtctgggacagngttcactctacacatcagcacgctgcagtcagtaagtatttcgacttaatttacttactntacagacgtataattaactaacgtcgtacccttaccgtacttaacgtttcggaccgtacgggacctacggtcgtaggacgtaactaacgaaacgtaacgtggtacggactacgactactaacg

SEQ ID NO: 69394 - DNA, 584 bp, Homo sapiens
  misc_feature: GYAE6OF02GY1HT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcaagaaacctggccaggcctcccgaggcctcctcatctatgatgcatccacgaagggccactgatactcccagccaggttcagtggctaggtgggtctggggacaggtagttaccacgttcctacacctatcagcacgtcctgcagtctagaagtattttgacttaatttattactgtactagacgtaagttaataaacgtaaacttcggtaccttacccgttacttacgttttacgggacccgtacggggtaacctaaggtccgtagggtaacgaacgttaacgaaaccggtaacgttggtacggtaccgtacggacctaaccgtacg

SEQ ID NO: 69395 - DNA, 670 bp, Homo sapiens
  misc_feature: GYAE6OF02IU42T.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctacgaggggaaancgccacctctcctgcagggccagtcagagtgtagcagcgtacttagcctggtaccagcaacggaacctggccaggcctcccgaggtcctccgtcatctaagtgatcgcactaccaagaaggcccagtgaacttacgccccagtaccgtaggttccaaggttgacctaaggggttcgggtaccgtggggaacctaaggtaccgtttaccaacgtttccaccaaccgtatccgaacggtcaacggtcctcggactaacggttctaagggtaaactttacgttttacggaactttaaatttttacgtttaaacgttcgttaaccgaagtaccgttaaggtttaaacttaaacgtaccgttaccggtcccttaaccggttttaactaacgttttacgggacccgtaaggggaccctaaggtccgttaggaactaacgtaacgaaacttacgtggaaccgttcgacgtacaccgtacg

SEQ ID NO: 69396 - DNA, 497 bp, Homo sapiens
  misc_feature: GYAE6OF02GRS0K.51.76.G10.1.454.CMB.1.raw
  modified_base (196)..(196): a, c, t, g, unknown or other
  misc_feature (196)..(196): n is a, c, g, or t
  modified_base (417)..(417): a, c, t, g, unknown or other
  misc_feature (417)..(417): n is a, c, g, or t
  modified_base (469)..(469): a, c, t, g, unknown or other
  misc_feature (469)..(469): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacagggccactgatactcccagccaggttcagtggcaggtgggtctgggacagacgttcactctcaccatcagcagcctgcagtctagaagtattttgactaatttattactgtcagnagtataatacgtgcctcgtactacgtttcgccgacgggactaggcgtagganatacgaacgtactgtgctcgacactacg

SEQ ID NO: 69397 - DNA, 833 bp, Homo sapiens
  misc_feature: GYAE6OF02HE43K.51.76.G10.1.454.CMB.1.raw
tcagcgatcgtatacacgaccggtgctcgatttagtcactcatacagggggaggaactgcgtcagttaggaccccagacggaaccatggaagccccagtcgcagcttctcttcctcctgctactctggctcccagataccactggtagagtagtgatgtacgctagtctcctagccaccctgtctgtcgtcgtccgaggggaaagacgcccgtaccccgtctcccgtgggccgaggggcccacgtcgacgtaggtggttacgcgaacgccgtaccttagcccttgggtacccaggtcaacgtaaacccgtcggaccgtaaggcctcccgacggtccttccctacgacgttccgtacgtcggattccgacgtacgtacccgaacgaacggggccctaacggtgaaacgtaccttaccccgaaggtccccgtaagggtttccgaagggttcggggaccgtaaggggtttacggggttaccgtacgggggaaacctacggtaacggtttacccacccggtttccgtaacccggaacccgtaacttacccgaaccgtaccgtaaccggtaccccgtaggaccgtaacgttaccgttacggtaaaacggttacttttacggacctttaaagttttactttaaccgttgtaccctaaggtaccgtaagttaacgtaaccgtaacgttaccggtacccctttaccggtaacgttaccgttttacgggacccgggtacggggtaaccgtaacggtaccggttagggtaacggtaaccgttaaccgtaaaaccggttacgttacggttacggtaccgttaccggtaccttaccgttaaccgg

SEQ ID NO: 69398 - DNA, 551 bp, Homo sapiens
  misc_feature: GYAE6OF02FXXWQ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccaggctcctcatctatgatgcatccacgaagggccatgatactcccagccaggttcagtggcaggtgggtctgggacagtagttcactctcaccatcagcagcctgcacgtcctagaacgtattttacgcttaagtttattaactgtactagactagtataaattaacgtcgtaccctaccgttaccttacgttttacggccgtacggggtaaccgaaggtcgtagggaagtacgtaacgaaacgtacgtacggttacggctacggacctaccgtac

SEQ ID NO: 69399 - DNA, 521 bp, Homo sapiens
  misc_feature: GYAE6OF02F080Z.51.76.G10.1.454.CMB.1.raw
  modified_base (194)..(194): a, c, t, g, unknown or other
  misc_feature (194)..(194): n is a, c, g, or t
  modified_base (350)..(350): a, c, t, g, unknown or other
  misc_feature (350)..(350): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaacctggccaggctcccaggctcctcatctatgatgcatccacaagggccactgatatcccagccaggttcaggtgcaggtgggtctgggacagngttcacgtctcaccatcagcagcctgcagtctagagtattttgacttaatttattactgtctagctaagtataataactcggtaccttccgtacttacgtttacggccgtaggggaccaggtcgtaggacgtataccgaaacgtacgttggtacggcgtacgactactacg

SEQ ID NO: 69400 - DNA, 548 bp, Homo sapiens
  misc_feature: GYAE6OF02GAPPV.51.76.G10.1.454.CMB.1.raw
  modified_base (197)..(197): a, c, t, g, unknown or other
  misc_feature (197)..(197): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
  modified_base (378)..(378): a, c, t, g, unknown or other
  misc_feature (378)..(378): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcagggccagtcagagtgttagcagcgacttagcctggtaccagcagaacctggccaggctcccaggcctcctcatctatgatgcanccanaacgggccactgatactcccagccgaggttcaggtggcaggtgggtcngggacagagttcactctcaccatcgagcngcctgctagtctagaagttagtttgacttaatttattactgtctagtactaagttataaacttacgtcgtacctaccgtacttacgtttacggaccgtacgggtaccgtaaggtcgtaggtacgtaacgtaccgaaacgtacgtcggtacggacgtacgaccgtactacg

SEQ ID NO: 69401 - DNA, 573 bp, Homo sapiens
  misc_feature: GYAE6OF02I4RAK.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagcccaccctctcctgcagggccagtcagagtgttagcagcgacttagcctggtaccagcagaaacctggccaggcctcccgaggcctcctcactctatgatgcatccacaagggccactgatactcccagccaggttcagtggcaggtggtctgggacaggagttcactctacaccatcagcacgtcctgacagtctagaacgtattttagacttaattttattactagtactagtactagttaataaacttacgtcggtaccttaccgttacttacgtttacggaccgtacggggaacctaaggtcgtaacggaacggtaactaacgtaaaccggtaacgttacgggttacggacgtacggtaccctaccgtacg

SEQ ID NO: 69402 - DNA, 553 bp, Homo sapiens
  misc_feature: GYAE6OF02H1U64.51.76.G10.1.454.CMB.1.raw
  modified_base (196)..(196): a, c, t, g, unknown or other
  misc_feature (196)..(196): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggcctcctnatctatgatgcatccacgaagggccacgtgatactcccagcctaggttcagtggcaggtgggtctgggacagtcgttcacgtctacgacatcagcacgcctgcagtctagaagttattttgacttaattttattacgtgtacagtacaagttactaaagttaaccgtcgtacccttccgtacgttacgtttcgggaccgtaggggacctaggtcgtaggtaagtactaacgaaacggtacgttggtacggactacgaccgtactaacg

SEQ ID NO: 69403 - DNA, 558 bp, Homo sapiens
  misc_feature: GYAE6OF02GVAYY.51.76.G10.1.454.CMB.1.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacgaagggccactgatactcccagccaggtcagtgcaggtggtctgggacagtagtcactctcacatcagcagcctgcagtctagtaagtntttgacttaatttattactagtcagtctaagttaataagtaacgtcgaccttccgttaacttacgttttcggaccgtacggggtacctaacggtcgtacgggtaagtaacgttaaccgtaaaccggtaacgttgggttaccggtaccgtacggtaccgaacccttacg

SEQ ID NO: 69404 - DNA, 541 bp, Homo sapiens
  misc_feature: GYAE6OF02HZOE4.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaaggccactgatactcccagcctaggttcaggtggctaggtgggtctgggacaggtagttcgctctcactatcagcagcctgcagtctagaagttatttgactaattttattacgtgtcagtactaagtattaataacgtcggtaccttccgttactacgtttcggacccgtaggggacctaaggcgttagggagtacgtaaccgaaacgtacgttcggtacggacgtcgacccacgtacg

SEQ ID NO: 69405 - DNA, 510 bp, Homo sapiens
  misc_feature: GYAE6OF02HLY7J.51.76.G10.1.454.CMB.1.raw
  modified_base (203)..(203): a, c, t, g, unknown or other
  misc_feature (203)..(203): n is a, c, g, or t
  modified_base (432)..(432): a, c, t, g, unknown or other
  misc_feature (432)..(432): n is a, c, g, or t
  modified_base (484)..(484): a, c, t, g, unknown or other
  misc_feature (484)..(484): n is a, c, g, or t
tcagcgatcgtatacacgaccggtgctcgatttagtcactcatacagggggaggaactgctcagttaggaacccaagacggaaccatggaagccccagcgcagcttctcttccctcctgctactctggctcccagataccactggagaagtagtgatgacgcagtctccagccaccctgtctgtcgtactccgaaggggaaanagcccaccctctcctgcagggccagtcagagtgttagcagcgacttagcctggtaccagcagaaacctggccaggcctcccaggctcctcatctactgatcgcatccacgagggccactgatatcccagccaggttccaggtggctaggtgggtctaggggacagtacgttcactctcaccatcgagcagcctgcagtctagaagtatttgctaatttattactgtcancagtataataactcgtcctcgtactacgtttgccgtagggaccagctagganatacgaaacgactggtgctgccacta

SEQ ID NO: 69406 - DNA, 582 bp, Homo sapiens
  misc_feature: GYAE6OF02IQDMF.51.76.G10.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaangcccaccctntcctgcagggccagtcagagtgttagcagcgacttagcctggtaccagcagaacctggaccaggcctcccaggcctcctcatctatgatgcataccacgacggccacgtgactactcccagccgtaggttcaggtcggcgtaggttgggtcgtagggacaaggtacgttccacttccgtaccaccatccagcacgcctgacgagttactagtaagttagttttagactttaatttactttacgtgtacgagtacgtaagttaactaaattaaccgtcggtacccttccgttaaccttacgtttcggaccgtacgggaaccgtaaggtcgtaggaacgtaactacgaaacgtacgtggtacgtacgtcgacctacgtac

SEQ ID NO: 69407 - DNA, 544 bp, Homo sapiens
  misc_feature: GYAE6OF02HHOI1.51.76.G10.1.454.CMB.1.raw
  modified_base (196)..(196): a, c, t, g, unknown or other
  misc_feature (196)..(196): n is a, c, g, or t
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctangatgcatccacgaagggccactgatatcccagccaggttcagtgcaggtggtcngggacagtacgttcactctcactatcagcacgcctgcagtcgtgtaagtatttgactaatttactacttgtactagactagttaataataacgtcgtccttaccgttacttaccgttttcggaccgtacggggtacctaaggtcgtaggaacgtacttaaccgaaacggtacttcggtcggtacgtacgaccgtacctacg

SEQ ID NO: 69408 - DNA, 518 bp, Homo sapiens
  misc_feature: GYAE6OF02HGGM4.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgttagcagcgacttagcctggtaccagcagaaacctggccaggctcccaggctcctcatctatgatgcatccacaagggccactgactactcccagccaggttccaggtgcaggtggtctgggacagagttcactctcacatcagcagcctgcagtctagaagtattttgataatttattaacttgtacagctaagtataataactcgcctacgtacttacgtttacggccgtacgggacctaggtcgtaggtacgactacgaaacgacttggtagtcgtacgacctactacg

SEQ ID NO: 69409 - DNA, 551 bp, Homo sapiens
  misc_feature: GYAE6OF02HLFTS.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactcccagcctaggttcagtggcaggtgggtctgggacagtagttcactctcacatcagcagctgacagtctagtaagtatttagtactaattttattacttgtacagctaagtaataataacgtcgtaccttaccgtacttaccgttttacggaccgtacggggacctaacggtcgtagggaagtaacttaaccgaaacgtaacgttcggtacggacgttacggacctaccgtacg

SEQ ID NO: 69410 - DNA, 562 bp, Homo sapiens
  misc_feature: GYAE6OF02HLBMY.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccaccctctcctgcagggccagtcagagtgttagcagcgacttagcctggtaccagcagaaacctggccaggcctccaggctcctcatctatgatgcatccacgaagggccactgactactcccagccaggttcagtggctaggtgggtctagggacagagttcactctcacatcagcacgctgcagtctagagtatttgacttaatttattactgtactagactaagttaataaacgtaacgtcggtaccttaccgtacttacgtttacggaccgtacggggtaaccaacggtcgtagggaacgtaacgtaacccgtaaaacggtacgttacggtacggtacgtacggacctacccgttaacg

SEQ ID NO: 69411 - DNA, 764 bp, Homo sapiens
  misc_feature: GYAE6OF02F1LAA.51.76.G10.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctcctgcagggccagtcagagtgttagcagcgacttagcctggtaccagcagaaacctggccaggcctcccgaggcctccctnactctatgatcgacactaccaacgtaacgggccctacgtgaactacgtaccccaaggcccgtaaggtttcgaacggtcgggaccgtagggtttcggggtccgttagggggtaacctaggggtaaccgttttaccaacccgtttccgtaccctaacccgtaacgttacccgaaccggaccgaaccggtcccgttacggaccgtacggttaccttaagggtaaacgtttaacgtttttacggaacttttaaaacgtttttaacgtttaaccttacggttaacgtaacggttaccgttaaaggtttaaacgtttaaaacgtttaaaccggttaccgggttaaccccgttttaaccggtttaaaccggtttaaccggtttttcgggaacccgggtaacggggtaaccgtaacgggtcgtacgggtaacgtaacgtaacgtaaaaccggtacgttcggtacggtctacgacctaccgtacg

SEQ ID NO: 69412 - DNA, 732 bp, Homo sapiens
  misc_feature: GYAE6OF02HBEA2.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgttagcagcgtacttagccgtggtaccagcaagaaacctggccaggcctcccgaggcctccgtcatctatcgatgcactaccgacgaacgggccaacgttcgaattaaccgtccccgaagtccccgtaaggtttcccgaacggtttggggaccctaagggtttcgggggtccgttagggggaacccgttaaaggtaaccgggttttcaaccctttcgttacccgaacccgtacttacgaacggaccgtaaaccggcccttcggaccgtacggttacttaacggtaaagttacgtttttacgtaacgttaaactttttaccgtttaacggttcgttacgtaacgttacgtaaacgttaacgttaaacgttaaaccgttccgtacccgttaacccggttacttaccgttttacggacccggtacggggaacctaacggtcgtacggtaacgtaacgtaaccgtaaacgtacgttcggtaacggtccgtacgtaccctaacgtacg

SEQ ID NO: 69413 - DNA, 646 bp, Homo sapiens
  misc_feature: GYAE6OF02JN88Z.51.76.G10.1.454.CMB.1.raw
  modified_base (106)..(106): a, c, t, g, unknown or other
  misc_feature (106)..(106): n is a, c, g, or t
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
  modified_base (413)..(413): a, c, t, g, unknown or other
  misc_feature (413)..(413): n is a, c, g, or t
tcagcgatcgtatacacgaccggtgctcgatttagtcactcatacagggggaggaacgtgctcagttaggacccagacggaaccatggaagcccagcgcagcttcncttcctctgctactctggctcccagataccactggagaagtgtgatgacgcagtctccgagcccacctgtctgtcgtctccgaggggaaanacgcccaccctctcctgccagggccagtcagngtgtagcagcgtacttagcctggtacngcagaacctggcaggcctccaggcctcctcactctangtatcgcactaccgacacgggcctatgactcgtaccccagccgaagttcaaggttcggactacgggtaggtccgtaggggactaaggtacgttccacgttcctaccgaacctatccacgngaccggtctagcgtagtcgtagtacgtagttttacacgttaaactttacttacgttacgtacgtacgtacgtaataacgtttaaactacggttccggtaacgttccccgttaaatttcccgttttagggaacccggtacgggtacccggtagttaaccgggtacggtaaggtaccttaaaccgaaaccgggttacgttacgggttcgtaccggttacgtaccccgtagttacg

SEQ ID NO: 69414 - DNA, 626 bp, Homo sapiens
  misc_feature: GYAE6OF02I91AC.51.76.G10.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (284)..(285): a, c, t, g, unknown or other
  misc_feature (284)..(285): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaagggggaaangcccctaccctctccngcgagggcctagtcaggagtcgttagcagcgactgcctggacagcagaaccngccaggcncccagctcnntntatgatncanccacgacggccactganactcccagcctaggtcaggtcgcgaggttgggtcctaggggataggtagttaccacgttacctaccaacctagtaccgaacgactaacgcccgtacggacgtacggttaccgtaggtaaacgttattttacgtaaccttaaagttttacttaaccgttgtaccgacgtactaaaggttaactaaacgttaacgtccgtaacccttccgtaacgtttcgtttaccgggaccgtacgggtaccgtaacgtaccggttaaggtaagtaacgtaactaaacggtacttagggtaccgtcgtacgacctaaccgtcg

SEQ ID NO: 69415 - DNA, 598 bp, Homo sapiens
  misc_feature: GYAE6OF02JABSY.51.76.G10.1.454.CMB.1.raw
  modified_base (199)..(199): a, c, t, g, unknown or other
  misc_feature (199)..(199): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatggacgcagtctccagccaccctgtctgtgtctaccgaggggaaanagcccaccctctcctgcagggccagtcagagtgttagcagcgacttagcctggtaccagcagaacctggccaggctccgaggctcnatctatgatgcataccacgaagggcccatgacgtactcccgagcctaaggttcaaggtggcctaagggttcggggtcctaggggacctaggtacgtttccaacgttcctacgacctagtacacgtcacgccttgacgtagtcgtagaagtatttagacttaaacgtttattctagtacagtactaagtataagtaactcggtaccttaccgtactacgtttcggaccgtagggtacctaaggtccggtaggtaacggtaacttaaccgaaacggtacgttaggtaccggtaccgtacgtaccgaaccgttacg

SEQ ID NO: 69416 - DNA, 739 bp, Homo sapiens
  misc_feature: GYAE6OF02JHZN5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaacgtgctcagttaggacccagacggaaccatggaagcccagcgcagcttctcttcctcctgctactctggctcccagataccactggagagtagtgatgacgcagtctccagccaccctgtctgtgtctccgaggggaaancgcccacctctcctgcagggccagtcagagtgttagcagcgtacttgcctggtaccagcaacgaaccgtggccaaggcctacccgaggtccctccgtaccattcctagtggtactcgcactcccaacgaacgggccactgactactacccagccaggttaccaggttcggcaacgggttcggggtcagggggaacctagggtaccgttttccgaaccgtttcccgtacgaaaccctacgtaccgtacggaccgtaacggtcccgttacggaccgttacgttacggttacggtaaacggttacgtttttacggtaacctttaaacgtttttaacttaccgtttacgttacggtaacggtacttaacggttaaattaaacgttaaccgttacggttaccctttaaccggtttaacctaaccgtttttcgggacccgggttagggggtaacccaagggttacccggtagggtaacgtaaaccgttaacgtaaaacccgtaacgttacggttaacggtacccgttacggaccgttacccgttaaccg

SEQ ID NO: 69417 - DNA, 530 bp, Homo sapiens
  misc_feature: GYAE6OF02H7JV3.51.76.G10.1.454.CMB.1.raw
  modified_base (195)..(195): a, c, t, g, unknown or other
  misc_feature (195)..(195): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatcctatgatgcatccanaacgggccactgatactccagccaggttccagtggcaggtgggtctgggacagagttccactctacacctatcagcagcctgcagtctgtaagtatttgactaatttattactgtacagactaagtataattacgtcgtaccttccgtactacgttttcgaccgtagggaccaaggtcgtaggtagacttacgaaacgtacgtacggtacggtactacgtccacctacg

SEQ ID NO: 69418 - DNA, 690 bp, Homo sapiens
  misc_feature: GYAE6OF02IDUGJ.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagacagaaacctggaccaggctcccaggcctcctcatctaagtgactgacatcccaacgaaacggggcccactaggactaacctccccgaaggtccccgaaggtttccgaagttcgggactagggttcggggtcttacgggggacaagggtacggtttccaactcctaccgtaaccgaacttcgaagcccaggtcctaggactacgtacgtaggtaaacgtattttagaccttaaattttacttaacgttgtaaccgtagtaccttaaacgttaattaaacgttaaaccttccgggtacccgttaccggttaacccttacgtttttaccgggacccgtaaccggggtaacctaacggtaaccggttacgggaacgtaacgtaaccgtaaaacggtaaccgtaacgggttcggtaccgtacgttacccgaccttaaccgg

SEQ ID NO: 69419 - DNA, 591 bp, Homo sapiens
  misc_feature: GYAE6OF02HA623.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccaggcctcctcatctatgatgcactccacgaacgggccactgaatactcccagcctaggttcaggtggcgaggttgggtctggggacagtacgttcactctacaccatcagcacgtcctgcagtctagtaagtattttgacttaatttacgttactcgtacgtagtaccgtaagttaacttaaagttaaccgtggtaccccttaccggttaacctacgttttcgggacccgtacgggggtaacctaagggtcgtagggtacgtaacgtaccgaaaaccggtacgtggtacggtacctacggtaccgaacctaccg

SEQ ID NO: 69420 - DNA, 484 bp, Homo sapiens
  misc_feature: GYAE6OF02G0RHP.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatctcagccaggttcagtggcagtggtctgggacagagttcactctcaccatcagcagcctgcagtctgaagtattttgactaatttattactgtcagcagtataataactgtcctcgtactactttggccgagggaccaagctaggagatacgaacgactgtgctgctac

SEQ ID NO: 69421 - DNA, 575 bp, Homo sapiens
  misc_feature: GYAE6OF02HR9AO.51.76.G10.1.454.CMB.1.raw
  modified_base (297)..(297): a, c, t, g, unknown or other
  misc_feature (297)..(297): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaacctggccaggctcccaggcctcctcatctatgatgcntccacgaagggccatgactactcccgagccaggttcagtggcgagtgggtctgggacagtacgttcactctcaccatcagcacgcctgcagtctagaagtatttgacttaatttattactgtacagtactagttataaagtaacgttacgggtacccttcccggttaaacttaccgttttacgggaccgtacggggaaccctaacgggtcgttacgggtagtaacgtaaccgtaaacggtacgtacgggttacggaccgttacggacctaccgtaacg

SEQ ID NO: 69422 - DNA, 535 bp, Homo sapiens
  misc_feature: GYAE6OF02HR7GG.51.76.G10.1.454.CMB.1.raw
  modified_base (195)..(195): a, c, t, g, unknown or other
  misc_feature (195)..(195): n is a, c, g, or t
  modified_base (371)..(371): a, c, t, g, unknown or other
  misc_feature (371)..(371): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgttagcagcgacttagcctggtaccagcagaacctggccaggctcccaggctcctcatcatgatgcatcccacaagggccactgatactcccagcctaggttccagtggctaggtgggtctgggacagtacgttcactcgtcaccntaccagcagcctgcagtctagaagtatttcgataattttatactgtcagtctaagttataagttacgtgtcccttaccgtactaccgtttcggaccgtacgggaccaacggtctagggataacgtacgtaaacgtacgtggtcggtacgtacgtaccacgttac

SEQ ID NO: 69423 - DNA, 532 bp, Homo sapiens
  misc_feature: GYAE6OF02HLE0M.51.76.G10.1.454.CMB.1.raw
  modified_base (375)..(375): a, c, t, g, unknown or other
  misc_feature (375)..(375): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctccaggctcctcatctatgatcgcatccacaacgggccacgtgactactcccagccaggttcagtggcaggtgggtctgggacagagttcactctcaccatcancagcctgctagtctagaagtatttagacttaattttattacttgtatagactaagtaataagtaactcggtacctaccgtacttacgtttacgaccgtacgggacctaggtcgtaggagtactacgaaacgtacgtggtggtccgtgaccacgtacg

SEQ ID NO: 69424 - DNA, 567 bp, Homo sapiens
  misc_feature: GYAE6OF02JRJEE.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagcccaccctctcctgcagggccagtcagagtgttagcagcgacttagcctggtaccagcagaaccgtggccaggctcccaggcctcctcatctatgatgcatccacgaggccatgactacgcccagtccaggttcagtcggacaggtcgggtctaggggactaggtacgtttccacgttcgtacacctactcacgcacgcctcgactacgtcgtagtaagtagtttacgtacttaatttattacgtgtacagtacgtagttaataagttacgtcgtaccttacgtacgttacgtttcggaccgtacgggtaccgtaggtcgtacggacgtacgtacgaacgtacgtcggtacgtacgtacgacacgtacg

SEQ ID NO: 69425 - DNA, 566 bp, Homo sapiens
  misc_feature: GYAE6OF02H9MLQ.51.76.G10.1.454.CMB.1.raw
  modified_base (197)..(197): a, c, t, g, unknown or other
  misc_feature (197)..(197): n is a, c, g, or t
  modified_base (518)..(518): a, c, t, g, unknown or other
  misc_feature (518)..(518): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccacctctcctgcagggccaggtcagagtgttagcagcgacttagcctggtaccagcaagaaacctgggaccaggcctcccaggcctcctcatctatgatgctactcccaagaaacgggtccattagatacgtcccaaggtcctaaggttccaagttcgggactagggtcgggtacgtggggaacagtacgttcactctcaccatcagccgagcctgcagtctagaacgttatttcgattaatttattactgtacgagtacaagttataaacgtaactcgtccttaccgtactacgtttggacctagggaacctacgngtaggactaagttaacgaaactaacgtcggtgtacgtcgactactacg

SEQ ID NO: 69426 - DNA, 620 bp, Homo sapiens
  misc_feature: GYAE6OF02JIR45.51.76.G10.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
tcagcgatcgtatacacgaccggtgctcgatttagtcactcatacaggggaggaactgctcagttaggaccagacggaaccatggaagcccagcgcagcttctcttcctcctgctactctggctcccagataccactggagaagtagtgatgacgcagtctccagccaccctgtctgtgtctccgaggggaanagccaccctcncctgcagggccagtcagagtgtagcagcgacttagcctggtaccagcagaaacctggccaggcctaccccgaggccttccgtactactcgtaatggaactcgacactccaacggtaacgggcctaactgaactactcccgaagcctaaggttcaagtcggactaggtcggtctacggggacaggtcgttcacttcctacaccactacacgcgacgccgtacgactacgtctagtaacgttagttacgtacttaactttacttacgttagtacttagtactaagttaataagttaacgttacgtaccgttaaccgttacgttaacgttttcggaccgtacgggtacctaacggtacgttacggtacggtacgtaacgtaaacggtacgtacggtacgacgttacgaccgtacctacg

SEQ ID NO: 69427 - DNA, 583 bp, Homo sapiens
  misc_feature: GYAE6OF02JHPIO.51.76.G10.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccacctctcctgcagggccagtcagngtgttagcagcgacttagcctggtaccagcagaaacctggccaggctccaggctcctcatctatgatgcatccacgaagggccactgacttactcccagccctaaggtttccaggttcgggctaagggtcgggtactggggaacaggtaacgtttcaccgttctacaccgatccgaacgcaacgcctgacagtctagaagtatttgacttaatttacttactgtacagtctaagttataataacgtcgtaccttaccgtactacgttttacggaccgtacgggaccgtaacggtcgttacgggaacgtaacgtaacgaaacgtaacgtacgggtacgacgtacgtacctaaccgtacg

SEQ ID NO: 69428 - DNA, 524 bp, Homo sapiens
  misc_feature: GYAE6OF02FSKLQ.51.76.G10.1.454.CMB.1.raw
  modified_base (196)..(196): a, c, t, g, unknown or other
  misc_feature (196)..(196): n is a, c, g, or t
  modified_base (399)..(399): a, c, t, g, unknown or other
  misc_feature (399)..(399): n is a, c, g, or t
  modified_base (412)..(412): a, c, t, g, unknown or other
  misc_feature (412)..(412): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcactccacgaacgggccactgatactcccagcccaggttcaggtggctaggtcgggtcgtgggacaggtagttcactctcaccatcagcagcctgcagtctgatntttgactaatttnttactgtcagtcagttataatacgtgtacctccgtactacgtttggccgtaggggaccaaggtcgtaggacgtagtaccgaaacgtacgtcggtaggctcgacctacctacg

SEQ ID NO: 69429 - DNA, 578 bp, Homo sapiens
  misc_feature: GYAE6OF02IE6IS.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgattagcctggtaccagcagaaacctggccaggctccaggctctcatctatgatgcatccagaacgggccactgatactccagccaggttcagtcggacaggtggtcgtgggactagagttcacgtctaccaccatcacgcacgtcctgctagtctagtaagttatttacgataagttttacttactgtactagtactaagttataacttaacgtcggtacccttaccgttaacgttccgtttttacggaccggtacggggtaaccctacggtcgtaacggtagtaaccgttaacgaaacggtaccggttaggtacgtaccgtacggaccgtacctaccgg

SEQ ID NO: 69430 - DNA, 707 bp, Homo sapiens
  misc_feature: GYAE6OF02JU1MR.51.76.G10.1.454.CMB.1.raw
  modified_base (144)..(144): a, c, t, g, unknown or other
  misc_feature (144)..(144): n is a, c, g, or t
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
  modified_base (324)..(324): a, c, t, g, unknown or other
  misc_feature (324)..(324): n is a, c, g, or t
  modified_base (543)..(543): a, c, t, g, unknown or other
  misc_feature (543)..(543): n is a, c, g, or t
tcagcgatcgtatacacgaccggtgctcgatttagtcactcatacaggggaggaactgctcagttaggacccagacggaaccatggaagccccagcgcagcttctcttacctcctgctactctggctcccagataccactgganaagtagtgatgacgcagtctccagccacctgtctgtgtctccaggggaangccaccgtctccgtgcctaggggcccaggtccanaggtcgttacgacacgtcgacgttacgcctcggtaccgacgcgagaaaccgtggccgacgctaccccaggaccgtcctacactacgtctagacgtnccgatccgacaaacggggtccacttacgacgtaacttacccgacgtaccgtacggtttacacggtgggaccgtaacggtttacggggtccgttagggacgtaagtacgttacgtaccctcgtaccacgtactacgacgacgacgtcccgtgacgtacgtacgtacggtaacgttagttttagtaccttaattttacttttaaccgtcgtaaccggttanacggttacttaagttaaacgtaaacgttccgtaccggtaccgtttaaccgtacggtttttacgacccgggaagggttacccggaaggtaccgttcggaaagtacccgttaacgtaaaccgtaacggttacgtccgggtaactacggttacccaacccttaacgg

SEQ ID NO: 69431 - DNA, 566 bp, Homo sapiens
  misc_feature: GYAE6OF02IXQ7M.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccgaggctcctcatctatgatgcatccaacgacggccactgactactcccagcctaggttcaggtgcaggtggtctgggacagtagttcacgtcctacacctactacacgcgacgcctagctagtcgtagtaagttattttagacttaaattttattacgtgtcaagtctaagttaataaacttacgtcgtacccttaccggttacttaacgtttcggaccgtacggggaacctaaggtcgtaggaacgtacgtaacgaaacggtaacgttggtacggacctcgacctacgtac

SEQ ID NO: 69432 - DNA, 551 bp, Homo sapiens
  misc_feature: GYAE6OF02G99HV.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggcctcctcatctatgactgcatccacgaagggccatgactactcccagcctaggttcagtggcaggtggtctgggacagtacgttcacctctacaccatcagcgacgcctgcagtctagtaagtatttgacttaatttattacttgtcagctaagtataattacgtacgtccttaccgtaacttacgtttacggaccgtacggggacctaaggtccgtaggaacgtaacgtacgaaacgtaacgttcggtacggtccgtacggaccaccgtacg

SEQ ID NO: 69433 - DNA, 614 bp, Homo sapiens
  misc_feature: GYAE6OF02ISXPN.51.76.G10.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctcncctgcagggccagtcagagtgttagcagcgacttagcctggtaccagcagaacctggccaggctcccaggctcctcattcatgatcgcatccacgaagggccctatgatactcccagccaggttcagtggcaggtggtctagggacagtacgttcactctacaccactcgacgcgacgcctgtcacgtacgtagtaacgtattttacggacttaaacgtttactttaacgttgtacctacggtctaaacgttaagttaaacttaaacgtcgggttacccttaccggttaacttaccgttttacgggacccggtacggggtaacccgaacggttcgttaacgggtacggtaacgttaaccgaaaacggttaaccgtggttaccggaccgttacgtacccgacccttacg

SEQ ID NO: 69434 - DNA, 608 bp, Homo sapiens
  misc_feature: GYAE6OF02IKCZ3.51.76.G10.1.454.CMB.1.raw
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (329)..(330): a, c, t, g, unknown or other
  misc_feature (329)..(330): n is a, c, g, or t
tcagcgatcgtatacacgaccggtgctcgatttagtcactcatacaggggggaggaactgctcagttaggacccagacggaaccatggaagccccagcgcagcttctcttcctctgctactctggctcccagataccactggagaagtagtgatgacgcagtctccagccaccctgtctgtgtcncgagggaaangccacctctccngcaggccagtcagagtgtagcagcgacttagcctggaccagcaagaactggcaggcnccagctctcatctatgatgctacncacgaaggccaacngatacgaccagccngttacgngtcggnnggtcggtcgaggacagtacgtcactcacacatacgacgacgacgtcgtagacgtagtactagtaagttattttagaacttaatttacttacgttacgtacgtagtacgttaaagtaacgtaaacgttaacggtccggttacccttaaccggttaacttaacggtttaccggtaaccggtaacggggtaacctaaggtacggttaagggtaacgtaaacgttaaaccggaaaacggttacggtacggttaccggtacgtacggtaccctaaccgttacg

SEQ ID NO: 69435 - DNA, 512 bp, Homo sapiens
  misc_feature: GYAE6OF02FS9GD.51.76.G10.1.454.CMB.1.raw
  modified_base (197)..(197): a, c, t, g, unknown or other
  misc_feature (197)..(197): n is a, c, g, or t
  modified_base (384)..(384): a, c, t, g, unknown or other
  misc_feature (384)..(384): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctgggacagagttcactctcacatcagcagcctgcagtcngaagtattttgactaatttattacttgtactagtcagttataattaactcggtaccttccgtactacttttcggcctaggggaccaaggcgtaggagactacgaaacgactaggtggctcgcactacg

SEQ ID NO: 69436 - DNA, 553 bp, Homo sapiens
  misc_feature: GYAE6OF02HB0M9.51.76.G10.1.454.CMB.1.raw
  modified_base (196)..(196): a, c, t, g, unknown or other
  misc_feature (196)..(196): n is a, c, g, or t
  modified_base (317)..(317): a, c, t, g, unknown or other
  misc_feature (317)..(317): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttgcctggtaccagcaagaaacctggccaggcctcccaggcctcctcatctatgatgcatccacaaggccactgatacnccagccaggttcagtgcaggtggtctgggacagagttcactctcacatcagcagcctgctagtctagaagtatttgacttaaatttacttacttgtaccagtaccgtaattaaataacttaacgtcggtaccttacccggttacttaaccgttttggacccgtaggggacctaacggtcgtagggactaaacgtccgaaaacggtacgttggtacggtctacggacctaacctacg

SEQ ID NO: 69437 - DNA, 539 bp, Homo sapiens
  misc_feature: GYAE6OF02G6O04.51.76.G10.1.454.CMB.1.raw
  modified_base (198)..(198): a, c, t, g, unknown or other
  misc_feature (198)..(198): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccaactggagaagtagtgatgacgcagtctccagccaccctgtctgtgtctccgaggggaaanagccaccctctcctgcagggccagtcagagtgttagcagcgacttagcctggtaccagcagaacctggccaggctcccaggctcctcatctatgatgcatccacaacgggccactgatactcccagcctagttcagtggcaggtgggctggganagacgttcactctcacatcagcagcctgcagtctgaagtatttgacttaatttattacttgtctaagtctaagtaattaacgtaacgtcggtaccttaccgttactaccgttttggacccgtacgggtacctaagtcgtaggacgtacgtaccgtaaacgacgttgtacggtctacgtacacctacg

SEQ ID NO: 69438 - DNA, 524 bp, Homo sapiens
  misc_feature: GYAE6OF02H6VAG.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggccaggctcccaggctcctcatctatgatgcatccacaagggccactgatactcccagccaggttcaggtggcaggtgggtctgggacaggagttcactctcaccatcagcagcctgcagtctagtaagtattttgacttaatttattactgtctagctaagtataataacgtgtccttccgtactacgtttggaccgtacgggtaccaggtcgtaggagtaactacgaaacgtacgtcggtaggcgtacgccactacg

SEQ ID NO: 69439 - DNA, 563 bp, Homo sapiens
  misc_feature: GYAE6OF02HUW2W.51.76.G10.1.454.CMB.1.raw
  modified_base (197)..(197): a, c, t, g, unknown or other
  misc_feature (197)..(197): n is a, c, g, or t
  modified_base (362)..(362): a, c, t, g, unknown or other
  misc_feature (362)..(362): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccaggctcctcatctatgatgcatccacaagggccactgatactccagccaggttcagtggcaggtgggtctgggacagagttcactcncaccatcagcagcctgctagtctagtaagtattttgacttaatttattacgttgtacagtactaagttataaattaacgttcggtacccttaccgttaaccttaccgttttcgggacccgtacgggggtacccaagggtccgtagggaacgtaacgtaaccgaaaccgtaacgtcggtacggtcgtacggcctacctaacg

SEQ ID NO: 69440 - DNA, 527 bp, Homo sapiens
  misc_feature: GYAE6OF02IT96B.51.76.G10.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
  modified_base (393)..(393): a, c, t, g, unknown or other
  misc_feature (393)..(393): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccanaacgggccactgatactcccagccaggttcagtcggcaggtgggtctgggacagagttcactctcaccatcagcacgcctgcagtctgaagtntttgacttaatttattactgtacagtctaagtataatactcggtccttaccgtactacgtttcggaccgtacggggacctacggtcgtaggaggtaactacgaaacgtacgtggtacgtcgtcgtacacctacg

SEQ ID NO: 69441 - DNA, 525 bp, Homo sapiens
  misc_feature: GYAE6OF02G93H9.51.76.G10.1.454.CMB.1.raw
  modified_base (197)..(197): a, c, t, g, unknown or other
  misc_feature (197)..(197): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccaggcctcctcatctatgatgcatccacaacgggccactgactactcccagcctaggttcagtggcaggtgggtcngggacagagtcactctcacatcagcagctgcagtctagatatttgacttaatttattactgtactagtactagttataagtacgtcgtaccttccgtacttacgtttcggaccgtagggaccaggtctacggataacgtacgaaacgtacgtgtcggactacgtaccactacg

SEQ ID NO: 69442 - DNA, 721 bp, Homo sapiens
  misc_feature: GYAE6OF02JZGQ2.51.76.G10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (582)..(582): a, c, t, g, unknown or other
  misc_feature (582)..(582): n is a, c, g, or t
tcagcgatcgtatacacgaccggtgctcgatttagtcactcatacaggggaggaacgtgctcagttaggaccagacggaaccatggaagcccagcgcagcttctcttcctcctgctactctggctcccagactaccactggagaagtagtgatgacgcagtctccagccaccctgtctgtagtctaccgaggggaaangccaccctntcctgccagggccagtcagagtgttacgcagcgatttacgccttaggtaccagacacgtaaacctgggacccaacggcgttaccccgaggggtcccttaccccgtacaacttctaagtcgaacgttgcctaactacccgaacggaaagggcccctaacgtgaacttaccgcccaaaggccctaagggtttacccaggttggaccgtaggttcggggttacacggggaacaggtaccgtttacgaaccttttccgactaaccgattaccgacgtacgaggtccctagaccgaacgttcgtacggtaaagttcgttttacgtaccttaaattttacttaaactcggttacctaagtaccgttaataacggtttaaanaaccgtttacggtacccgttaaacccgtttagtttaacccgtttaggtacccggaacgggtttccgaaacggtcggtaaccggtagtaacgtacccgaaaggttaacgtcggtaggacccttaggacctacccggttaa

SEQ ID NO: 69443 - DNA, 572 bp, Homo sapiens
  misc_feature: GYAE6OF02JBYS4.51.76.G10.1.454.CMB.1.raw
  modified_base (365)..(365): a, c, t, g, unknown or other
  misc_feature (365)..(365): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctccccaggcctcctcatctatgatgcatccacaagggccactgatatcccagccaggttcagtggcaggtgggtctgggacagagttcacttcncaccatcagcagcctgcagtctagaagtatttgacttaatttattacttcgtacagtacgtaagttaataaacgttaacgttcggtacccgttaccgttaaccgttaccgtttttacgggacccgtacggggtaacccgtaacggtccggttaggacggtaacttaaccgaaacgtaacgttggtacggtcgtcgaccgtactaccg

SEQ ID NO: 69444 - DNA, 577 bp, Homo sapiens
  misc_feature: GYAE6OF02G179M.51.76.G10.1.454.CMB.1.raw
  modified_base (196)..(196): a, c, t, g, unknown or other
  misc_feature (196)..(196): n is a, c, g, or t
  modified_base (251)..(251): a, c, t, g, unknown or other
  misc_feature (251)..(251): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccngcagaacctggccaggctcccaggctcctcatctatgatgcactccaacgaagggccagtcgaactactcccagccctaggttcaggtggacctagggtgggtctaggggacaggtacgttcaccgtctaccacctagtacagcagcctgcagtctagaagtagttttcgacttaacttttattacttgtacagtctaagttaataagttaacgtcggtaccttaccggtacttacgttttacggaccgtacggggtacctaacggtcgtaggtaacgtaacgtaccgtaaacggtacgtacggtacggtcgtcgtaccacctacg

SEQ ID NO: 69445 - DNA, 591 bp, Homo sapiens
  misc_feature: GYAE6OF02I9R6O.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggcctcccaggctcctcatctatgatgcatccacagggccatgatatcccagccaggttcagtcgggcagggtgggtcgtggggaacaggtacgttcacttccttcgaaccatcgaagccacgcctgctacgtctagtaagtattttgacttaattttattacgttgtacgtacgtcgtaagttaataaacgttaaccgttcggtaccctttacccgtaccgtttaaccgtttcggacccggtaggggtaaccctacggtcgttaggaccgtaacgtaccgaaaaccggtacgttaggtacggtactacggaccgtacctaacg

SEQ ID NO: 69446 - DNA, 532 bp, Homo sapiens
  misc_feature: GYAE6OF02HXNGE.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcagaacctggccaggctcccgaggctcctcatctatgatgcactccacgaacgggccactgatactcccagccgtaggttcaggtggctaggtggtctgggactaggacttcactctacacatcagcagcctgctagtctagtaagtatttgtacttaatttattactgtacagtactaagtataactacgtacgtccttacgtactacgtttacggaccgtacgggactaggcgtaggagtacgtacgaacgtacgtcgtacggtctacgtcactcg

SEQ ID NO: 69447 - DNA, 651 bp, Homo sapiens
  misc_feature: GYAE6OF02IR61T.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagttgttagcagcgacttagcctggtaccagcagaaacctggccaggcctcccgaggcctcctcatctatgatgcatccacgaacgggccagtagtatactcccgagcctaggttcgaagtcggcgtaggtggggtcgtgggacaggtacgttacctactccgtaccaccagttaccgaacgcacggtacctcggtactacggttcgtaggtaagtttattttcgtaacgtttaaatttttacgtttaacgtcgtactaggtacttaagttaagtaaacttaacggttcggtaccccgttacgttaaccgttaacgttttaccgggacccggttacgggggaacctacgggtcgtacgggtaacgtaaccgttaaccgaaaacggttaccgtagggttaccggtcggtaccgtaccgtaccttacg

SEQ ID NO: 69448 - DNA, 584 bp, Homo sapiens
  misc_feature: GYAE6OF02HSHG6.51.76.G10.1.454.CMB.1.raw
  modified_base (386)..(386): a, c, t, g, unknown or other
  misc_feature (386)..(386): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaagagccgccctctcctgcgagggccagtcagagtgttagcagcgacttagcctggtaccagcagaaacctggccaggctcccaggctcctcatctatgatgcactccacgaagggccactgatactcccagcctaggttcaggtggcgaggttgggtcgtaggggacagtacgttcactctaccaccatccngcacgcctgctagtctaggtaagtatttgacttaattttacttacgtgtacgagtacctaagttaataaacgttaacgttcggtacccttccgtacttaacggttttaccgggaccgtacgggggtacctaacgggtcgtagggaacgtaacgtaaccgaaaacggtacgttacggtacggcgtacgacctacctacg

SEQ ID NO: 69449 - DNA, 543 bp, Homo sapiens
  misc_feature: GYAE6OF02GOF7W.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggcctcccaggcctcctcatctatgatgcatccacaagggccactgatactcccagccaggttcagtggacaggtgggtctgggacagtacgttcactcctacactactcagcacgcctgcagtctagaagtatttcgacttaatttattacttgtacagtactagtataattacgtacgtacccttaccgttacttacgttttcggaccgtacgggtaccaaggtcgtaggtacgaacgtaacgaacgtacgtagtacggtacgtacgccactacg

SEQ ID NO: 69450 - DNA, 624 bp, Homo sapiens
  misc_feature: GYAE6OF02I6Z8K.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctccctgccagggccagtccagagtgttagcagcacttagccttggaccagccagaaaccgtggcccaggcctcccgaggcctcctcgactctatgactgccaatccaacgtaacgggccactgactagtccccagtccacggtttcaacggtcggctacgggtcgggttctacggggacaacggtacgtttccgaacttcctccgaaccgactacgacgtacacgtcctgacgtacgtctagaagttacgtttgtacgttaacttttaacttaccgttggtacctacgtacaagtttaataacttaaccgttcggtacctttaccgtacttacgttttccggacgtacgggaccaagtccgtaaggagtacgtaaccgaaacggtactacggttacggctacggtacaccgttacg

SEQ ID NO: 69451 - DNA, 482 bp, Homo sapiens
  misc_feature: GYAE6OF02JFHD6.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctctcatctatgatgcatccacaagggccactgatatcccagccaggttcagtggcagtgggtctgggacagagttcactctcacatcagcagcctgcagtctagagtatttgactaatttatactgtcagcagtatataactgtacctcgtactcgtttgccgagggacagcgtggagacgtacaacgactgtgctgcactacg

SEQ ID NO: 69452 - DNA, 574 bp, Homo sapiens
  misc_feature: GYAE6OF02IFR2R.51.76.G10.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtcctaccgaggggaaancgccacccttcncctgcagggccagtcagagtgttagcagcgattagccgtggtaccagcagaacctggaccaggcctcccgaggcctcctcaactctacgtgactgactatccaagacggcctactgtaactcctaccgagtccgtaagtccaaggtcgacgtgggtcggtcagggactagtacgttcaccgtctcaccatcagctacgctgacngtcngtatacgttcgattagtttatctntcgtacgtacgtattaacgtaactacgtcgtccgtaccgttagtactttcgggaccgtaggggacctaaggtctagggtaacacgttaaccgaagtaccgtaggtacgttacacggttaccaccgttacg

SEQ ID NO: 69453 - DNA, 551 bp, Homo sapiens
  misc_feature: GYAE6OF02GZTI8.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcactctatgatgcatccaacaacgggccactgatactcccagccagttcagtgcagtggtctgggacagagttcactctacacactcagcagtcctgcgtacgtcgtagaagttagttttcgacttaattttattactgtcagtacgtaagttactaagtactcgtcccttacgtactacgtttggacccgtacggggtaacctacgggtactacgggtaagaacgttaacgaaacgtacgtaggtacggacgtacgtacaccgttacg

SEQ ID NO: 69454 - DNA, 490 bp, Homo sapiens
  misc_feature: GYAE6OF02GQBEP.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccatgatatcccagccaggttcagtggcagtgggtctgggacagagttcactctcaccatcagcagcctgcagtctgaagtattttgactaatttattactgtcagcagtataattaactgtcctcgtactactttcgacctagggaccaagctaggagatacaacgtactgtcggctgcactac

SEQ ID NO: 69455 - DNA, 588 bp, Homo sapiens
  misc_feature: GYAE6OF02J2NEX.51.76.G10.1.454.CMB.1.raw
  modified_base (199)..(199): a, c, t, g, unknown or other
  misc_feature (199)..(199): n is a, c, g, or t
  modified_base (374)..(374): a, c, t, g, unknown or other
  misc_feature (374)..(374): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctaccgaggggaaanagcccaccctctcctgcagggccagtcagagtgttagcagcgacttagcctggtaccagcagaacctggccaggctcccgaggctcctcatcatgatgcatccacgaacgggtccaactgatactcccagtcccaggttccaggtcggctaggtgggtctgggacagtacgttcnctctcaccatcagcacgctgcgtacgtctaggtaagtacttttgaccttaagttttacttaacgttgtacctaagccgtaagaccgtaaaacgtaccgttacggtccctcggttacggtaccgttcggacccgtaagggacccgtaaggtcggtaaacgtaccgaaacggtacctaggttacggtaccgtacgacgtaccctagttccgttacg

SEQ ID NO: 69456 - DNA, 692 bp, Homo sapiens
  misc_feature: GYAE6OF02JQNME.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccaggtaccactggagaagtagtgatgacgcagtctccagccacctgtctgtgtctccgagggaagcgcccacctctcctgcgacgggccagtcagtagtgttacgcgagcgtacgttacgccgtcggtacccaggacaacgaaacccgtgggacccgaacgggccctaccccgaagggcctacccgtctactccttagtcggaattcgccaactcccgaaacgaacgggccctaacgtaggaacttaccgtaccccgaggcccgttaagggttaccgaagggtcgggaccgtaaggttcgggttaccgagggacctagtaccgtacctacgtccgtacacctacacgacgctacggcctagcctacggtactaggtaaatttcgtttcgaatttacgtttaattccgtagtcagtacgtaagttaaccgttaattaaccgtcggtacctttaccgtaacgtttacgttaccggtacgggaccggtacaacgtcgggtaacggaatacgtaaaccgtaaaccggtagaccggttacggtactacgtaccctacgttaccttaccg

SEQ ID NO: 69457 - DNA, 581 bp, Homo sapiens
  misc_feature: GYAE6OF02IUTYC.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangcccaccctctcctgcagggccagtcagagtgttagcagcgacttagcctggtaccagcaagaaacctggccaggcctcccgagctcctcatctatgatgcatccacgaacggccactgatactcccagccctaggttcagtcggcgtaggtgggtcgtagggacaggtacgttaccaccgttcctaccgaacctacgtccagcgacgtccctgccgtagtctagaagttattttacgacttaattttattacttagtacagtactagttaataacttaacgtcggtacccttaccggttaacttacgtttacggaccgtacggggacctaaggtcgtaggaacgtagtaacgaaacgtactcggtacggctacgacctacgtacg

SEQ ID NO: 69458 - DNA, 527 bp, Homo sapiens
  misc_feature: GYAE6OF02HYYVR.51.76.G10.1.454.CMB.1.raw
  modified_base (194)..(194): a, c, t, g, unknown or other
  misc_feature (194)..(194): n is a, c, g, or t
  modified_base (296)..(296): a, c, t, g, unknown or other
  misc_feature (296)..(296): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccacctctcctgcagggccagtcagagtgttagcagcgacttagcctggtaccagcagaacctggccaggctcccaggctcctcatctatgatgcatccanaagggccactgatactcccagccaggttcagtggcaggtcggtctgggacaggtacgttcactctacacctatcagcagcctgcagtctagtagtatttgactatttactactgtactagtctagtataactactcgccttcgtacttacgtttcggaccgtaggggacctaggtctacggtacgtacgttaccgaacggtacgttacggtcggtacgtcgtaccactacg

SEQ ID NO: 69459 - DNA, 679 bp, Homo sapiens
  misc_feature: GYAE6OF02JZ3FM.51.76.G10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (295)..(295): a, c, t, g, unknown or other
  misc_feature (295)..(295): n is a, c, g, or t
tcagcgatcgtatacacgaccggtgctcgatttagtcactcatacaggggaggaacgtgctcagttaggacccagacggaaccatggaagccccagcgcagctctcttcctcctgctactctggctcccagataccactggacgaagtagtgatgacgcagtctccagccacctgtctgtagtctccaggggtaangccaccctntcctgcacgggccagtcagacgtgtagctaagcgacttagccttggtaccagtcaaggaacctggaccaggcctaccccgagtccgtccnctactcgtactggacttggacctataccgacgaaacggggcccctaaaagttcggtaacttactccccaaagggttccccaaaggggttttccaaacggttgggaccctaaggttcggggtaccttaggggaaccaaggttccgttacccgtaacgtcgtttaccacctagtaccgacgtaccgaacggtcctaggtacctagttacgtcgtaaacgttcgttttaacgcttaacgtttatttaccgtgtaccgtagtaccgttagtactaacgtaacgtcggtaccttacggtactacgtttggacctacgggaacctaggtcgtaacggtctaacgaccgtaacggtacgttaacgcggttacgtacgaccgtaagtacccg

SEQ ID NO: 69460 - DNA, 602 bp, Homo sapiens
  misc_feature: GYAE6OF02FO6UH.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatactcccagccaggttcagtggctaggtgggtctgggacaggtagttcacgttcacacatcacgcacgcctgacagtctagaagttatttacgtacttaaattttacttaacgttcgtacgtagtacgtaagttaacttaaagttaaccgttacggttacccgttacccgttaacgttaaccggtttttacgggacccgtacgggggtaaccgtaacggtacggtagggacgtaacgtaacgtaaaccggtaacgttcggttacggacgttacggtaccgtaccgtacg

SEQ ID NO: 69461 - DNA, 508 bp, Homo sapiens
  misc_feature: GYAE6OF02ILIY8.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcagtggtctgggacagagttcactctcaccatcagcagcctgcagtctgagtatttgctaatttattactgtcagctagtataataactggtaccttaccgtactacgtttggacctacggggacctaaggtctaggagtaatacgaaacgtactggtacggctgccacctacg

SEQ ID NO: 69462 - DNA, 513 bp, Homo sapiens
  misc_feature: GYAE6OF02FGJWN.51.76.G10.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
  modified_base (414)..(414): a, c, t, g, unknown or other
  misc_feature (414)..(414): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaanacgccaccctctcctgcagggccagtcagagtgttagcagcgacttagcctggtaccagcagaacctggccaggcctccaggctcctcatcatgatgcatccacaacgggccatgatactcccagccaggttcaggtggctaggtggtctgggacnggacttcactctcacatcagcacgcctgctagtctagaagtagtttgactaattttatactntcagctagtactaatactgtacctcctacgtacgtttcggaccgtagggacaggctaggagtactacgaaacgtacgtgtcggctacgtaccaccgtac

SEQ ID NO: 69463 - DNA, 803 bp, Homo sapiens
  misc_feature: GYAE6OF02IGDCZ.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtcgtctccgagggggaaanacgcccaccctctcctgcagggcccagtccaggagtgttagcagcgtacttagcctggtaccagcaagaaacctcggaccaggcctcccgaggcctccctcatcctatgactgactactccaacgaacgggccctaagtagacttactccccacgaccgtaggtttccgaggtcggacgtagggttcgggttcgtacgggacgtaaggtacgtttccgaccttcctccaacctacgtaccgacggtacgacgtcccgtacgtccgtaacggttaccgttagggtaaacgtttacgtttttacgtaaccgtttaaaagttttttaaccgtttaaccgtttacggttaacccgtaaggttaacccgtttaaaagtttaaacttttaaaacgttaaacccggtttccgggtaccccgttttaaccccggttaaacgttttaaccccgggtttttacggggtaacccccgggtaacggggggtaaccccgttaacggggtacccggttaagggggtaaccgtaaaccgttaaacccggtaaaaacccgggttacggttaccggttacggggtacccgttaaccggtacccgtaaccccgttaaccg

SEQ ID NO: 69464 - DNA, 759 bp, Homo sapiens
  misc_feature: GYAE6OF02HED4U.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagagcccaccctctcctgcgagggccagtcagagtgttagcagcgacttagcctggtaccagcaagaaccgtggaccaggcctccgagcctcctcatctatgatcgcactccgacgaacggccacgtgactacctacccgagtccgtaggtttacgacgggtcggacgtacggggtttcggggttaccgtacgggggaacctaagggttaccgtttaccgtaacccgttcccttaacccgaacccgtaacgttaccgaaccggacccgtaaccggtccccgtacggtacccgtaacgggtttaccgtaaacgggttaaacggttttacgtttttaacggtaaccttttaaacgtttttaacgtttaccgttacggttacgtaacgtacgtaacgtttaaacttaaacgttaaccggtttaccggtacccgtttaaccggttaacctttaccggttttacgggaccgggttaccgggtaaccgtaacggtcgttaaggtaacgtaacgttaaccgaaaccggttaacgttacgggtacgtaccggttacgacccgtacttaccg

SEQ ID NO: 69465 - DNA, 590 bp, Homo sapiens
  misc_feature: GYAE6OF02I80DP.51.76.G10.1.454.CMB.1.raw
  modified_base (440)..(440): a, c, t, g, unknown or other
  misc_feature (440)..(440): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcgagggccagtcagagtgttagcagcgtacttagcctaggtaccagcaagaaacctggccaaggcctcccgaggcctccgtcactcatcgatcgacactccaacgaggccactagactactcccagcctaaggttcaggtggacgtaggtcgggtcgtagggactagacggttccacgtctacacctagtcagccagtccctagactaacgtctaaggaaacgtttnttacgtacttaatttacttactagtacctagtactaattaactaacgtacgtcggtaccttccgtattacgttacggaccgacgggaactacggcgtaggacgtaacgtaaccggtaacgtacgtggtaccggtactcgacctacgtacg

SEQ ID NO: 69466 - DNA, 918 bp, Homo sapiens
  misc_feature: GYAE6OF02FJJDM.51.76.G10.1.454.CMB.1.raw
tcagcgatcgtatacacgaccggtgctcgatttagtcactcatacgaggggtaggaacgtgctacagttaggacccagacggaaccatggaagtccccgagcgcagcttcttcttcctcctgcttaacgtctcggctcccagataccactggagaagtagtgagtggacgcagtctccgtaggtccacccgtgtccttagtcgtctccgaggggaaagcgccaacccgtcttacccgtggtaccgtacggggccctaggttccaacggaggttcggtttaaggcctacggccggaaccgtttaaggccccttagggttaacccgaagggtccgtaacggtaaaacccgttgggaccctacgggaccttcccccgaaagggtacccttcccgttacggtaacgttaccttaacgtaccgtaacgttcggtaacctaacgttaccccgtaaaccggtaaacgggggggtcccctaaccgttacgggtaacttaaccgttacccccgaacggtaccccgtaacgggtttaaccctaaccgggttaggggaccgtacgggttacggggttaccgttacggggtaaaccttacgggtaacggtttaccgaaccgttaccttaccgaacccgaacgttccgaacgtaccgaacggtacccgtacggccgtaacggttccgtacggtaaaacgttacgttttttacggaccttaaaagttttaacgttaaccgtttgtacccgtaacggtacgaaacgttaacgtaaaacgttaacgttacggttacccgtttaaccgtttaaacgtttaccggttttacggacccggtacggggtaaccctaacgggtccgtacggtaacgtacgttaccgtaaaacgtaccgttacggttaccggtaccgtccggtaccgtacccgttaaccg

SEQ ID NO: 69467 - DNA, 606 bp, Homo sapiens
  misc_feature: GYAE6OF02JIXNR.51.76.G10.1.454.CMB.1.raw
  modified_base (419)..(419): a, c, t, g, unknown or other
  misc_feature (419)..(419): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaagacgcccaccctctcctgcagggccagtcaggagtgttagcagcgacttagcctggtaccagcagaaacctggccaggctcccaggtctctcatcatgactgcatccaagaacggtccactgactacgtcccagccaaggttcagtggctaggtcggtcagggaacaggatttccaactctacaccgatcgacgctacggactcgacagttcgaagtaagttntttacgacttaattttaactacgtagtaccagtacttaacggttattaaagttaaccgttcgttaaccctaccgtaacgttaacgttttcggaacccggtagggtaaccacggtcgttaacgggtaaagtaccgttaaacgaaaccgttacggttacggtccggtacttaacggcccttaacgtacg

SEQ ID NO: 69468 - DNA, 668 bp, Homo sapiens
  misc_feature: GYAE6OF02JZ9AK.51.76.G10.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagcgatcgtatacacgaccggtgctcgatttagtcactcatacaggggaggaacgtgttcagttaggacccagacggaaccatggaagccccagcgcagcttctcttcctcctgctactctggctcccagatccactggagaagtgtgatgacgcagtctccagcccacctgctgtcgtacctccgaagggggaaacngcccaccccttntccctggcagggcctagtcagagttgtagcagcgaacttgcctggaccngcagaactgcagctccagctcncatctangatgacctaggtccaacgtaacgggccctacgtagacttactaccccaagccccgtaagggtttccacggttacggggctaacggggttcgggtaccgtcggggtaacagggttacggttaccacggttacctacccgtaccagtacgacggtacctagaccgtcgaccgtaacggtccgtacggtaagttagtttcggacctttaagtttaacttaacgtcgtaacgtacgttaacacgttaactaacttaacgtccgtaccgttaccgtttaccgtaacgtttccgtaccgtaacgggcctaagtcggtaacggtacgtaacgttaaaccgaacgttaacgtacggttacggacgttcggaccgtacctagtaccg

SEQ ID NO: 69469 - DNA, 558 bp, Homo sapiens
  misc_feature: GYAE6OF02FNXCL.51.76.G10.1.454.CMB.1.raw
  modified_base (196)..(196): a, c, t, g, unknown or other
  misc_feature (196)..(196): n is a, c, g, or t
  modified_base (317)..(317): a, c, t, g, unknown or other
  misc_feature (317)..(317): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctgccaggctcccaggcctcctcatctatgatgcatccacaacgggccactgatacncccagcctaggttcagtggcaggtggtcgtgggacaggagttcactctcacctatcagcacgcctgctagtctagaagttagttttgacttaattttattacgttgtacgagtactaagttaattaaacttaacgtcgtcccttaccgttacttacgttttacgggcccgtacgggaacctaacggtcgtaggacgataaccgaaacgtacgttacggtacggctacggtacctaccgtac

SEQ ID NO: 69470 - DNA, 878 bp, Homo sapiens
  misc_feature: GYAE6OF02GDJWQ.51.76.G10.1.454.CMB.1.raw
  modified_base (101)..(101): a, c, t, g, unknown or other
  misc_feature (101)..(101): n is a, c, g, or t
tcagcgatcgtatacacgaccggtgctcgatttagtcactcatacaggggaggaactgctcagttaggacccagacggaaccatggaagccccagcgcagntcccggttaccgtttaccgttacccgttacggtaccgttaaccgttaccgttacggtaccgttacccgtacggtacgtaccgtacgtacggtacgtaacgttacggtacgtacgtacggtaccggtaccgtacggtaccgtaccgtacgtaccgtaccgtacgtaccgtacgtacgtaccgtaccgtacgggtaacgtacgtaccgtaccgtacgtaccgtcgtaccgtacgggtcctacgtcgtacggtacgtacgttacgtccgtacggtaccgtacgttacgtccgttacggttacccaggtcctacggtaaacccttggtacctacgggtccttacccgaggtccttaccgtacgtaacgttccgtaacggttcggtaacttcggtaccgtacgttacccgtacggtaacgggttccctaagttacgggtaaccttacggtcccgtaaggttcccgaaggtttccgacggttacgggtacctacggttcgggttactacgggaacctacggttaccgttcgacccgtttagtaccgtaccgtacgtacgtacggtaccgtaacggtcccgttaggtaccgtacggtacccgttacggaacgttaccgtttcggaccttaacgttccgtacgtcggtacctacgtacgtacgttacgtactacggtcgaccgttaccgtacgtaccgttcgacccgttaggacccttaggaccgttggacctacgttaccgaacgttccggtgtaccggaccgtacgttaccgaccgttacggg

SEQ ID NO: 69471 - DNA, 580 bp, Homo sapiens
  misc_feature: GYAE6OF02HM7OX.51.76.G10.1.454.CMB.1.raw
  modified_base (196)..(196): a, c, t, g, unknown or other
  misc_feature (196)..(196): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctgggacagngttcactctcacatcagcacgcctgcagtctagaagtattttgacttaattttacttacttgtctagtctaagttaattaaataacgttcggtacccttacccgttaacttaccgtttttacgggacccgtacgggggtaaccctaacgggtcgtacgggtaacgtaacgttaaccgaaaacggtaaccgttacgggttacggaccgtacgtaccctacccgttaacg

SEQ ID NO: 69472 - DNA, 643 bp, Homo sapiens
  misc_feature: GYAE6OF02IVKXJ.51.76.G10.1.454.CMB.1.raw
  modified_base (196)..(196): a, c, t, g, unknown or other
  misc_feature (196)..(196): n is a, c, g, or t
  modified_base (402)..(402): a, c, t, g, unknown or other
  misc_feature (402)..(402): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccaccctctcctgcacgggccagtccagagtgttagcagcgattacgcctggtaccagcaagtaaacctgggaccaaggcctcccgaggcctcctacatctagtgatagcactccaacacgggccacttgactactccagcaggttccaggtcggctaggtcggtctgggacagtcttacactcgacacctatcgacgtaccgngtacccgtgaccgtagtaccgttaggaacgttacgtttacgtactttaaacgttttacgtacgttcggtaacctaagggtaccttaaaggttaacttaaaaccgttaccgttacgggtcctttacccgaagttttaacccggtttaggaaccccggtaaggggtaaccctaggtaccggttagggacgtaaacgttaccgaaacggttacgtcggttacggaccttaggacctactaacgg

SEQ ID NO: 69473 - DNA, 573 bp, Homo sapiens
  misc_feature: GYAE6OF02FS4ZS.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcaagaaacctggaccaggcctcccgaggcctcctcatctatgatcgacactccaacgaacgggcctactgactactcccagccctaggttcaggtggctaggtcgggtctgggacaggtacgttcacttcacaccatcagcacgtctgcagtctagtagttatttgacttaatttattactgtacagtacgtaagttataaacgtacgtcggtaccttaccgtacttacgtttcggaccgtacgggacctaaggtcgttaaggacgtaacgttaacgaaacggtacgttcggtacggaccttacggacctaccgtacg

SEQ ID NO: 69474 - DNA, 700 bp, Homo sapiens
  misc_feature: GYAE6OF02I1PJL.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcagaacctggccaggctcccaggcctcctcactctatgatgcatccaacgacggaccactgactacgtcccacgtccaggttcaggtggactaggtgggtacgtgggactaggtacgttccacgttcctacaccacgtcacgctaacggcctcgtcgacggttaccgtaagtaacgtttacgttttagtaacctttaaagttttaactttaaccgtttcggttacgtaagtaccgttaagtttaaactttaaacgttaaccgttacgggttaacccgtttaacccgttaaaccggttttaaccgttttaccggggtacccgggtaaccgggtaaacctaacggggtaccggttacgggtaaaccggtaaaccgtttaaccgaaaacggttaacccggtaggggtttaaccgggtacccgtacggtaacccgtacccgttaacccgg

SEQ ID NO: 69475 - DNA, 571 bp, Homo sapiens
  misc_feature: GYAE6OF02GSNZH.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctcatctatgatgcactccaacgaagggccactgactactcccagcctaggttcaggtggctaggtgggtcgtgggacaggtacgttcactcctacaccatacagtacgcctgctagtctaggtaagttattttagactttaattttacttacttgtactagtactaagttaattaaacgtacgtacggtacccttaccgttaacttacgttttcggaccgtacggggtaccaaggtcggtaggaagtactaacgaaacgtacgttaggtcggtcgtacgactacctattccg

SEQ ID NO: 69476 - DNA, 597 bp, Homo sapiens
  misc_feature: GYAE6OF02GILMI.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgttagcagcgacttagcctggtaccagcagaacctggccaggctccgagctacctcatctatgatgcatccaacaacgggccaacttgactactcccagcctaggttcagtggcaggtggtctgggacaggtacgttcacgttctcgaccacgtacacgcacgcctgtacaggtctagaacgttattttacgaccttaatttttactacgttgtacacgtactaagttaacttaaagttaaccgttggtacccttaccgttaacttaaccgttttaccggacgtacgggtaaccgtaacggtccgtagggtaacgtaacgttaactaaaaccggtaactacgggttacggacgtacgtaccgaccttaacg

SEQ ID NO: 69477 - DNA, 549 bp, Homo sapiens
  misc_feature: GYAE6OF02IKMYC.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggccaggcctcccgaggcctcctcatctatgatgcatccacgaacgggccaactgaactactcccagccgtaggttcaggtgcaggtggtctgggacagtattcactctacactatcacgcacgctgctagtctagaagttatttcgattaattttattactgtactagtactaagttaataagttaacgtcgtacccttacgtacttaccgtttcgaccgtacgggaactacggcgtaggagtaactaacgaaacgtacgttggtacggtctacgaccactacg

SEQ ID NO: 69478 - DNA, 565 bp, Homo sapiens
  misc_feature: GYAE6OF02I36UN.51.76.G10.1.454.CMB.1.raw
  modified_base (200)..(200): a, c, t, g, unknown or other
  misc_feature (200)..(200): n is a, c, g, or t
  modified_base (361)..(361): a, c, t, g, unknown or other
  misc_feature (361)..(361): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtcgtctaccgaggggaaanacgccaacctctcctgcagggccagtcagagtgtagcagcgacttgcctggtaccagacagtaacctggaccaggcctcccaggtcctcctcattcgatgatcgcactccaagaacgggccaactgaactactcccagtccaggttcagtgcagttcgggnagggacagtacgttcactctnaccngtccagcacgtctgcgacgtctagtaacgtntttcgacttattacttactgtctagctagttaactaagtaccgtaggtacccttacgtacttaccggtttggacctaggggtactaacgtcggtaggacgtaacgtacgtaaacggtaacttcgggtagcgtacggacctacgtaacg

SEQ ID NO: 69479 - DNA, 512 bp, Homo sapiens
  misc_feature: GYAE6OF02FQDS1.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgatgcatccacaacgggccactgatactcccagccaggttcagtggcagtgggtctgggacagtagttcactctacaccatcagcacgcctgcctagtctgaagtattttcgacttaatttattactgtacagtctagttataatactcgtcctccgtactacgtttcgccgtacgggacagtcgtaggagtatacgaacgtactggtcggctcgacgactac

SEQ ID NO: 69480 - DNA, 947 bp, Homo sapiens
  misc_feature: GYAE6OF02FE37I.51.76.G10.1.454.CMB.1.raw
  modified_base (218)..(218): a, c, t, g, unknown or other
  misc_feature (218)..(218): n is a, c, g, or t
tcagcgatcgtatacacgaccggtgctcgatttagtcactcatacgaggggaggaactgctcagttacggacccagacggaaccatggaacgcccagcgcagcttctcttcctctgctactctcggctcccagactaccacgtggagtaagtagtgatcgacgctacgtcctccgacgcctacccttgtctggtcgtaccgtaccggaaggggaaacnccgccctacccgttcgtccgtggccgacggggtcctaggtacaggtagtgtacgcgaagtccgttacgtacgccgtaggtaaccagacctaacggtaaccgtggaccgtacggtcccctaccgacggtcccttccgtactacttacgttagacggtaccttcgaacctaaccggtaaccgtaacggtaacccgggtaccttaacgtacggttaacccttaaccccggtaccgtaacgggttaccggttaccggttagggtaaccgggttcgggaccggttaggggtaccgggttacggtaacggtaacgtaaccggtttaccttaacccggtacccttacgaacccgtaaccgtttacgacgggtaaccgccgttaaccgttaccggtaacggtaacggttacgtttacggaaagtttaacggtttttccttaaacgtaaacgtttttaagttaccttaacgggttaccgtaaacgtaacgtttaaacggttaaccgtttaaaaccgtttaaccgggtttaccccggtttaccgtttaaaccccggtatttttttaaaccccggggtacccggggttaaaccgggaaacccggggtttaacgaaccggttacgggttaaaccggggtaaccgttaaacccggttaaacccggtaaaaccggtaccgggtttaccgttaaccggtaccggtttaccctaacccggtttaccgtttaccggtttaacccgg

SEQ ID NO: 69481 - DNA, 714 bp, Homo sapiens
  misc_feature: GYAE6OF02H7F5O.51.76.G10.1.454.CMB.1.raw
  modified_base (198)..(198): a, c, t, g, unknown or other
  misc_feature (198)..(198): n is a, c, g, or t
  modified_base (329)..(329): a, c, t, g, unknown or other
  misc_feature (329)..(329): n is a, c, g, or t
tcagcgatcgtatacacgaccggtgctcgatttagtcactcatacagggggaggaactgctcagttaggacccagacggaaccatggaagccccagcgcagcttcctcttcctcctgctactctggctcccagataccactggagaagtagtgatgacgcagtctccagcccaccctgtctgtgtctccgaggggaanacgccacctctcctgcagggccagtcagagtgtagcagcgtattgcctggtaccagcaacgaacctggccaggcctcccgaggcctcctctatcctatgactgacatccacgaacggcacgtagacttacnccgagtcctaggttcaggtcggactagggtcgggtcgcgggacaggttcgttccacgtctacccgactactacgagaccgacgtccgtacggtactacggttaccgtaggttaacggttacgttttacggttaactttaagttttaacgtttacttacggtaccgttaaggttaaccgttaacggttaaacttaaacgttaacccggtacggttaacccgtttaccggtttaaacccgttacgggtttttaccgggaacccgggttaaccgggggtaaccgttaaccgggtaccggttaagggtaaccggttaaccgtaaaccgtaaaaccggttacggtacgggttaccggttaccggttaccggtaccctaacgttaacccgg

SEQ ID NO: 69482 - DNA, 592 bp, Homo sapiens
  misc_feature: GYAE6OF02H9NKY.51.76.G10.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccacctctctgcagggccagtcagngtnttagcagcgattagcctggtaccagcagaaacctggccaggctcccaggctcctcatctatgatgcatccacaacgggccactgaatactccccgagcctaggttccaaggtggacctagggtgggtctagggggcaagtacgttcactctccaccatcacgcagcctgcagtcctagtaagtattttgacttaatttatttactgtactacgtactaagttataaacgttaacgttcgggtacccttaccgttactaaccgtttttgggacccgtacggggtaaccaacggtccgttagggtacgtaacgttaaccgaaaccggtaacgtcgggtacggtaccgtacgtacccgaccttaaccg

SEQ ID NO: 69483 - DNA, 755 bp, Homo sapiens
  misc_feature: GYAE6OF02J0S5D.51.76.G10.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtcctgtcgtctccgagggggaaacncgtcccaccctctccgtggcagggccagtcagagttgtagcagcgacttagcctggtacagcagaaacctggccaggcctcccgaggtctcctnacttcgtaatcgtaangacctactaccaccgtacgggcctaacggtggccaacgttccccgaaggtccctaaggttcccaaggtcggcttaggggtcggtctagggaactggtacttcggacttcgactacgatccgagtaccacggccgttagacgtcccgttaggtaacgttacgtttcgtacgtttaaggttttaactttaacttcgggttactaacggtaccgtaacgggttaacccgtaaaaaccgtttccggtaaccggttccccgtttaggtttaaccgggaacccggttttaccggggaaaccccgttaaacggggtacccggtaaaaggggttttaccggaaaaaccggtttaacccggtaaaaccgggaacccggtttttaggtacccgggtaacgttaaccggttaacccccgtacctaacggttttaccccgttaccgggtttaaaccc

SEQ ID NO: 69484 - DNA, 572 bp, Homo sapiens
  misc_feature: GYAE6OF02IBDIP.51.76.G10.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcaagaaacctggaccaggcctcccgaggctccncatctatgatgcactccacgaacggccacgtgactactcccgagcccgtaggttcgagttcggacgtaggtcgggtcgtggggacaggtacgttcacctcctacacctactcagcacgcctcgcacgtactagaacgttaatttgtacttaatttaacttacttgtacagtctaaggttaattaactacgttcgtaccttaccgtactacgtttcggaccgtacgggaacctacggtcgtaggacgtacgtacgaaacgtacgtcgtcggacgtcgacactacg

SEQ ID NO: 69485 - DNA, 527 bp, Homo sapiens
  misc_feature: GYAE6OF02HM2PI.51.76.G10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgattagcctggtaccagcagaaacctggccaggcctccgaggctcctcatctangatcgcatccanacggccatgatactccagccaggttcagtgctagtggtcacgggacaggtacttcactctaccacatacagcacgcctgcagtctacgtagtatttagacttaatttattacgtgtactagtactaagttaataattacgtcgtccttacgtactacgtttgaccgtacgggtaccacgcgtaggactacgtacgaacgtacgtcgtagtcgtcacctactacg

SEQ ID NO: 69486 - DNA, 533 bp, Homo sapiens
  misc_feature: GYAE6OF02JBUDG.51.76.G10.1.454.CMB.1.raw
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaaacctggccaggctcccaggctcctcatctatgatgcatccacaagggccactgatatcccagccaggttcagtgcagtggtctgggacngattcactctacaccatcagcacgcctgctagtctagaacgtatttgactaatttatactgtacagtactagtaataataacgtcgtcctaccgttactacgtttcggcctaggggaccaacggtcgtaggacgtaacgttaaccgaaacgtaacgttggtacggtacctcggtacctaccgtacg

SEQ ID NO: 69487 - DNA, 625 bp, Homo sapiens
  misc_feature: GYAE6OF02I3XAL.51.76.G10.1.454.CMB.1.raw
  modified_base (227)..(227): a, c, t, g, unknown or other
  misc_feature (227)..(227): n is a, c, g, or t
  modified_base (345)..(345): a, c, t, g, unknown or other
  misc_feature (345)..(345): n is a, c, g, or t
  modified_base (426)..(426): a, c, t, g, unknown or other
  misc_feature (426)..(426): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagacgcccaccctctcctgcgagggccagtcagngtgtagcagcgacttagcctggtaccagcgaacgaaaccgtcggacctaggcctcccgaggcctcctcactcctatcgatcgccatccaacgaacgggcctaacgtgtactacacccnggacctaagggttcaggtcggctaggtcgggtactaggggtacaaggtacgttactaccgtctaccgactagtcgacgacncgtcctcggactaggtactaaggtacttagtttggaactttaagtttacttacgttacgctaacggttacaagttaacctaacgttacggtccggttaacccttacggttacttacgtttcgaccgggtaagtaccgtaaggtcgtaaggtaccgtaactacgtaaagtccggtagccggtacgtaccgtctacggtac

SEQ ID NO: 69488 - DNA, 670 bp, Homo sapiens
  misc_feature: GYAE6OF02HRL0D.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggaccaggctcccaggcctcctcatctatgatgcatccaacgaacgggccactgaactactcccgagcctaggttcagttcggcgtaggtacgggtctaggggactaggtacgttccaccgttcctaccaaccgtacttaccgaacgtccgaacggtccgttgacgtacggttaccgttaggttaaacgttaagtttttcggtaacttaaggttttttaactttaagtttcgtaccgtagtaccggtaagtaacccggaaaaacctacgttcgggaccctttacccggttagggaacccgtttacggggacccgtaaacggggaccgtaaaggggtaacggaaacgttaaccgtaaaacggtaacgttcggttaaggccgtagacccgtaactacgttcttaccgg

SEQ ID NO: 69489 - DNA, 692 bp, Homo sapiens
  misc_feature: GYAE6OF02JY7S4.51.76.G10.1.454.CMB.1.raw
  modified_base (106)..(106): a, c, t, g, unknown or other
  misc_feature (106)..(106): n is a, c, g, or t
  modified_base (200)..(200): a, c, t, g, unknown or other
  misc_feature (200)..(200): n is a, c, g, or t
  modified_base (372)..(372): a, c, t, g, unknown or other
  misc_feature (372)..(372): n is a, c, g, or t
  modified_base (441)..(441): a, c, t, g, unknown or other
  misc_feature (441)..(441): n is a, c, g, or t
tcagcgatcgtatacacgaccggtgctcgatttagtcactcatacaggggaggaacgtgcgtcagttaggacccagacggaaccatggaagcccagcgcagcttcncttcctctcgctactctggctcccagctaccactggagagtagtgatgacacagtctccagtcccaccctgtctgtgtctaccgaggggaaaangcccacccttctccctggccagggcccaaggttccagaggttcttagccaaggcgaattacggcctggtacccagcgaacgtaaaccgtggcccaaggccttaccccgaggtcctccctacaccgtcttagtgaaggttcactacctaccgacggtaaaccgggcctaaacnggtaactaccgtcccaagtcccagggttcacggtggactacggtgggcctagggactaaggcgtttacnccgttatcccgaacagtccacgtcacgccgttacgcgtacgtaccgttggtaactaggtttctaccgttaagtttaacttaccgttagtaccgtacgtagtacgttaaccgtaaagtaccgttaaccgtcgttaccgttaccgttaactttacgggtacccgttacggggaccttaaccggtccggttaaggtaccgtaacgttaaccgtaaccgaacgttcggtacgtacgtaccggtacctacggtacc

SEQ ID NO: 69490 - DNA, 616 bp, Homo sapiens
  misc_feature: GYAE6OF02HNIF5.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaancgccaccctctcctgcagggccagtcagagtgtagcagcgtacttagccgtggtaccagcaagaaacctggaccaggcctcccgaggctccgtacatctatgatgccatcccaagaacgggccatacgtatactcccgaagccgtaacggtttcgaagttgggacctagggtcgggtctggggactaggtacggttccacgttcgtacccaccataccgagccgacgcctgacagtcgtagtaagttagtttagacttaatttacgttactagtacacgtacgtaagtaagttaactaacgttcgtacccgttaccgttacttaacgttttacggaccgtacgggtaaccgtacggtacgtacggtacgtaacgtaacgtaaacgtacggtacgtaggtaccgtggtaccctactacg

SEQ ID NO: 69491 - DNA, 596 bp, Homo sapiens
  misc_feature: GYAE6OF02IAF8G.51.76.G10.1.454.CMB.1.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaagggggaaangcccaccctctcctgcagggccagtcagagttgtagcagcgacttagcctggtaccagcaagaaactggccaggctcccaggctcctcatctatgatgcatccaanaaggccaatgatatcccagccaaggtcagtgctagtgggtcngggnagngttcactctacacctatcagcacgtcctagctagtacgtagtaagttaacttttagtacttaaattttactttacgtcgtactagtcgaaagttaataaacttaacgttcggtacccttaccgtaaacgttacgttttacgggacccgtacgggggtaaccctaaggacgttaggaacgaaccgtttaaccgaaaaccggtaaccgttagggtacggacgttacggtaccctacctaaccg

SEQ ID NO: 69492 - DNA, 493 bp, Homo sapiens
  misc_feature: GYAE6OF02F92H2.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtgcagtgggtctgggacagagttcactctcacatcagcagcctgcagtctgaagtatttagctaatttattactgtcagcagtataataactgacctccgtactactttcgccgagggaccagctaggagactacgaacgtacgtcgtagctcgacactacg

SEQ ID NO: 69493 - DNA, 557 bp, Homo sapiens
  misc_feature: GYAE6OF02INCBU.51.76.G10.1.454.CMB.1.raw
  modified_base (196)..(196): a, c, t, g, unknown or other
  misc_feature (196)..(196): n is a, c, g, or t
  modified_base (514)..(514): a, c, t, g, unknown or other
  misc_feature (514)..(514): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaancgccaccctctcctgcagggccagtcagagtgttagcagcgattagcctggtaccagcagaaacctggccaggctcccaggcctcctcatctatgatgcatccacaagggccactgactactcccagccgaggttcagtggcgaggttggtcgtgggacagtacgttcactctaccacatcagcacgcctgcgtagtcgtagtaagttagttttgacttaattttaacgttactgtactagtctaagttaactaagttaacgtcggtaccttaccgttacttacgttttcggaccgtaggggaaccagtcgtaggtanaactaacgaaacgtacgtaggtcggtactacgtcctacctacg

SEQ ID NO: 69494 - DNA, 590 bp, Homo sapiens
  misc_feature: GYAE6OF02INLEZ.51.76.G10.1.454.CMB.1.raw
  modified_base (198)..(198): a, c, t, g, unknown or other
  misc_feature (198)..(198): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtcgtctccgaggggaancgcccacctctcctgcagggccagtcagtagtgtagcagcgattgcctggtaccagcagaacctggccaggccaccgaggcctcctcatctangatgcatccagacggccangactactccagtcctaggttcaggtcggactaggtcgggtcagggactaggacttcgactctacacctactacgagtcacgtctcgacgtacgtacgtagtagttagtttagtacttaatttattaccgtagtacgtacgtacttaagttaactaaacgttaacgtacgtaccgttaccgttacttacgtttacggaccggtacgggtaccgtacggtcgtacggtacgtaactaaccgtaaacggtacgtacggtcggtacgtacgtacctacgtaccg

SEQ ID NO: 69495 - DNA, 640 bp, Homo sapiens
  misc_feature: GYAE6OF02JXZXD.51.76.G10.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (311)..(311): a, c, t, g, unknown or other
  misc_feature (311)..(311): n is a, c, g, or t
tcagcgatcgtatacacgaccggtgctcgatttagtcactcatacaggggaggaacgtgctcagttaggacccagacggaaccatggaagccccagcgcagcttctcttcctcctgctactctgctcccagctaccacctggacgagtagtgatgacgcagtctccgagccaccctgtcctgtgtctaccaggggaaacngccaccctntccctgcagggccagtcagntgttancagcgacttgctggaccngcganaactggccaggcctcccgaggtctcctcactctagtcgatcggcatcccgaanaaggggcccctaatcgtatccgtacccgacgtacctaacggttccaaggcggtcaacggggtttgggcccttagggggtaaccaagggtttcgttaccctaaccggttccttccgaaacccgacgttaccgacgtccgaacgtccgttcgacgttaacgtccgtaggaaccgttagttacgtaccgttatttacttacgtacgttcgagtaccgtagttaatagttacctaggtacccttacgtacccgtagtttccgacgtacgggtactacgtacggtgaccgtacgtacgaacttacggtcgtacgtggtaccgtacctacgtacg

SEQ ID NO: 69496 - DNA, 683 bp, Homo sapiens
  misc_feature: GYAE6OF02FFJ89.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtcgtctccgaggggaaancgccaccctctccgtgcacgggccagtcagagtgtagcaggcgacttagccgtggtaccagcagaacctggcctacggcctacccgaggtcctcctcacgtctatgatcgcactccaacgaacggcctagtgtactaccgtcccacggtaccgtaggtttcgagggtacggcggttaggggttcgggtaccgtacggggaactacgggtacctttacccgaccgtttaccacccgaacctaacgttaccggaacggtacccgaacggtcccgttacggaccgttaacggttacgtaacggtaaacgttttacgttttacgaacttttaaagttttactacgttcgtaacagtactaagttaactaaacgttaaccgtccgttacccgtaccgttacgttaccgttaccggaccggtacggggaacctaggtacgtaggaacgtacgtaaccgaacgtacgtggtacgtcacggtacctactacg

SEQ ID NO: 69497 - DNA, 586 bp, Homo sapiens
  misc_feature: GYAE6OF02I67GI.51.76.G10.1.454.CMB.1.raw
  modified_base (451)..(451): a, c, t, g, unknown or other
  misc_feature (451)..(451): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggctcccagataccactggagaagtagtgatgacgcagtctccagccaccctgtctgtgtctccgaggggaaagacgcccaccctctcctgcagggccagtcagagtgttagcagcgtacttagcctggtaccagcagaaacctggccaggcctccaggctcctcatctatgatgacactaccgaacgaacgggccctacgtgactactcccgaagcctacgggttcaaggtcggctagggttcgggtcgtgggacaggtacgttcgactctaccactatcgacgcacgtcctgctacgtctaggaagttgtttacgacttaatttnttactgtacagtctaagtataactacgtacgtccttacgtacttacgtttcggaccgacggggtacaacggtcgtagggaacgtactaaccgtaaacgtacgttcggtacggtctacggtaccctaccgttaacg

SEQ ID NO: 69498 - DNA, 613 bp, Homo sapiens
  misc_feature: GYAE6OF02G5SVS.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctctcctgcagggccagtcagagtgttagcagcgacttagcctggtaccagcagaaacctggaccacggcctcccgaggcctcctcatctatgatgcactccgacgacgggccacgtgactacgtcccagtccgtaggttcgaggttcggactagggttcggggtactggggtaacaggtacgttacctactctaccacatccgagcacgcctgccgtagtctaggtaagttgttttacgtactttaagttttacttacgttcgtacgacgtacgttaagttaattaaacgttaacgttccggttacccttaccgttacgttaccggtttacgggacccgtacggggtacctaacggtcgtaaggagaacttaacggaacgtacgtggtacggctacgaccgtacctacg

SEQ ID NO: 69499 - DNA, 525 bp, Homo sapiens
  misc_feature: GYAE6OF02F3PH8.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacagggccactgatatcccagccaggttcagtggcaggtgggtctgggacagagttcactctcaccatcagcacgcctgcagtctagagtattttgactaatttattactgtcagtctaagttataataacgtcggtaccttaccgtacttacgttttcggaccgtaggggaccaaggtcgtaggaacgtactacgaaacgtactggtacggtctcgacctactacg

SEQ ID NO: 69500 - DNA, 712 bp, Homo sapiens
  misc_feature: GYAE6OF02JJB3Y.51.76.G10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccacctctcctgcgagggccagtcagagtgtagcagcgtacttagcctggtaccagcacgaaacctggaccaggcctcccgaggtcctccncatctatgatgcactccgaacacgggccagtgacttacacccacgccgtaggtttacaggttcggactacgggttcgggtcgtacgggactaacggttacgttccacgttacctaccaccgtactacgacgccgtaacgtccgtacgtcgacgttcgtaggtaacgtttacgttttacggtactttaaacgttttattaaccgttgtaccgtaacgttaacgtaagtttaacttaaacgttaaccggttccggttaacccgttaccggtttaacccgtttaaccggttttacgggaaccccggttacgggggtaaacccgtacgggttccggttaacgggtaacggttaaccgtaaaccgtaaaaccgggtaaccgttacgggtaccggttacgtaacccgggtacctaacccggttaacg

SEQ ID NO: 69501 - DNA, 542 bp, Homo sapiens
  misc_feature: GYAE6OF02I1G5O.51.76.G10.1.454.CMB.1.raw
  modified_base (197)..(197): a, c, t, g, unknown or other
  misc_feature (197)..(197): n is a, c, g, or t
  modified_base (406)..(406): a, c, t, g, unknown or other
  misc_feature (406)..(406): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccacctctcctgcagggccagtcagagtgttagcagcgacttagcctggtaccagcagaactggcaggctccaggctctcatctatgatgcatccacgaggccatgatactccagccaggttcagtgctaggtggtctaggggactagacgttcacgtctacacctatccagacacgtccctgactagtctagaacgtagttttanacgttaatttattactgtacagtactagttaataacttacgtcgtccttacgttactacgtttacggaccgtacgggtaccagtcgtaaggacgtaactaacggaaacgtacgtaggtacgctacgtacgactacg

SEQ ID NO: 69502 - DNA, 550 bp, Homo sapiens
  misc_feature: GYAE6OF02F8SYX.51.76.G10.1.454.CMB.1.raw
  modified_base (196)..(196): a, c, t, g, unknown or other
  misc_feature (196)..(196): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagccttggtaccagcagaacctggccaggctcccaggcctcctcatctatgatgcactccacgaacgggccatgactancccagccaggttcagtgctaggtggtctgggacagacgttcactctacacctatcagcagcctgctagtctagtaagtatttgacttaatttacttactgtacagtactagttaataataacgtcggtaccttaccgtacgttacgtttacggaccggtacgggtaccaacggtcgtagggacgtaacgtaaccgaaacgtacgtcggtacggtctacggacctacgtacg

SEQ ID NO: 69503 - DNA, 540 bp, Homo sapiens
  misc_feature: GYAE6OF02HB4EE.51.76.G10.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggcaggctccaggctccnatctatgatgcatccacgacgggccacgtgatactcccagccaggttcagtcggctaggtgggtctggggacaggtacttcactctcaccatcagcagcctgcagtctagagttatttgattaattttattacttgtctagtacgtaagttaataacgttaactcggtaccttaccgtacttacgtttcgggaccgtacggggacctaggtcgtaggtagtaacgtacgaacgtactcggtaggacctcgaccgactacg

SEQ ID NO: 69504 - DNA, 604 bp, Homo sapiens
  misc_feature: GYAE6OF02G3IMF.51.76.G10.1.454.CMB.1.raw
  modified_base (197)..(197): a, c, t, g, unknown or other
  misc_feature (197)..(197): n is a, c, g, or t
  modified_base (327)..(327): a, c, t, g, unknown or other
  misc_feature (327)..(327): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgtacttagcctggtaccagcagaacctggccaggcctcccgaggcctcctcatctatgtatcgctactccacgaacgggccacgtgactacncccgagccgtaggttcaggtggactaggtcgggtcgtgggactaggtacgttcacttcctaccacctacgtcacgcgacgtcctgtacgtacgtcgtagtaagttagtttacgtacttaatttacttactcgtactagtacttaagttaataacgttaacgtcgtacccttacgttacttacgtttacggaccggtacgggtacctaacggtcgtaggtaacgtaacgtaaccgaaacgttacggttcggtacggtccgtacgtaccctacgttacg

SEQ ID NO: 69505 - DNA, 508 bp, Homo sapiens
  misc_feature: GYAE6OF02JI42N.51.76.G10.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (407)..(407): a, c, t, g, unknown or other
  misc_feature (407)..(407): n is a, c, g, or t
  modified_base (476)..(476): a, c, t, g, unknown or other
  misc_feature (476)..(476): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgattagcctggtaccagcagaactggccaggctcccaggctcctnatctatgatcgcatccacgaacgggccaacttgaactactccccagccctaggttcaggtcggctaggtgggtctgggacaggtacgttcactctacaccagtcagcagcctgcacgtctagaagtntttgactatttatactgtcagtcagtataatacgtgtcctcgtatacgttcgcgaggacagcgtagganactacgaacgtactggtcgacgtgacctacta

SEQ ID NO: 69506 - DNA, 633 bp, Homo sapiens
  misc_feature: GYAE6OF02HYPPF.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcaggagtgttagcagcgacttagcctggtaccagccaagaaacctggccaggctcccgaggcctcctcatctatgatgcactccgacaagggcccaatgatactcccagcctaggttcaggtcggcgaggtgggtcgtagggactaggtacgttcaaccgttctaccgaacctataccgacggaccgtaacggccctggacctacggttcgtaggtaaagttattttacgtactttaaacttttacgttaacttgtaccgagtaacgtaagttaaacttaaagttaaccgtacgggtacccttaccggttaacttacggttttacggacccggtacgggtacccgaaggtcgtagggtacgtaacgtaaccgaaacggtacgtcgggtacgtaccgtacgacctacctacg

SEQ ID NO: 69507 - DNA, 507 bp, Homo sapiens
  misc_feature: GYAE6OF02F6PNO.51.76.G10.1.454.CMB.1.raw
  modified_base (196)..(196): a, c, t, g, unknown or other
  misc_feature (196)..(196): n is a, c, g, or t
  modified_base (402)..(402): a, c, t, g, unknown or other
  misc_feature (402)..(402): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacgaagggccaactgatactcccagccaggttcagtggcagtgggtctgggacagattcactctcacatcagcagcctgcagtctgaagtatttgactaatttnttactgtcagcagtataataactcgtaccttccgtactacgtttggaccgtagggaccaggcgtaggaagactacgaaacgacttaggtcggactgaccactacg

SEQ ID NO: 69508 - DNA, 569 bp, Homo sapiens
  misc_feature: GYAE6OF02GGDU5.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccaccctctcctgcagggccagtcagagtgttagcagcgacttagcctggtaccagcagaacctggccaggctcccaggctcctcatctatgatgcatccacaacgggccactgatactcccagccaggttcagtggcaggtgggtctgggacagtagttcactctacaccatcagcagcctgcagtcgtagagtatttgactaatttattactgttcagtactaagttaataagttaacgttcggtacccttaccgttaccttacgttttacgggacccgtacgggggtacctaagggtccgtagggtaacggtaacgtaaccgtaaaccggtaacgttagggtacggtacgtacgaccgtaccctacg

SEQ ID NO: 69509 - DNA, 531 bp, Homo sapiens
  misc_feature: GYAE6OF02JIGE5.51.76.G10.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagctagcgacttagcctggtaccagcagaaacctggccaggcctcccaggctcctcatctangatgcatccacaagggccatgatacncccanccagttccagtgcagtggctgggacaggtagttcactcgtcaaccatcagcacgcctgctagtctagtaagttagtttgactaatttacttacttgtacagacgtagtaataataacgtcgtccttacgtactacgtttcgaccgtacgggaccaaggtcgtaggagtactaacgaaacgtacgtaggtacgcgtagaccactaacg

SEQ ID NO: 69510 - DNA, 581 bp, Homo sapiens
  misc_feature: GYAE6OF02HA2A9.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccagttcagtggcagtgggtctgggacagagttcactctacaccatcagcacgcctgcacgtctagtaagtattttgacttaattttacttacttgttactagtacgtaagtaattaaactaacgttcggtaccttaccgttaccttaccgttttacggacccggtacggggtacctaacggtccgttacgggaagtaacgttaaccgtaaaaccggtaacgttacgggttacgggtacgtacggtaccgtacccgtacg

SEQ ID NO: 69511 - DNA, 650 bp, Homo sapiens
  misc_feature: GYAE6OF02GF1K3.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaangccaccctctcctgcagggccagtcagagtgttagcagcgtacttagcctggtaccagcagaaacctggccaggcctcccaggcctcctcatctatgatgcatccacgaagggccactgactactcccagcctaggttcaggtcggctaggtcgggtcgtagggacagtacgttcaccgttcctaccacctatccacgtccacgtccctggactacgtccgtagaacgtttagttttacgactttaaatttttaacgtttacgttacgttacgaacgttacgtaaggttaaacttaaacgttaaccgttcgggttaccccttaacccggtttaacgtttaccgttttacgggacccgtacgggggtaaccctaacggtcggttacgggtaacgtaacgtaaccgaaaaccggttaccgttgggttacccggtcgttaccgggacctaacgtaccg

SEQ ID NO: 69512 - DNA, 825 bp, Homo sapiens
  misc_feature: GYAE6OF02HW0LA.51.76.G10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaangcccacctntcctgcagggccagtcagagtgttacgcagcgacttagcctaggtaccagcaagaaaccgtgggaccaggtcctacccgaggtcctacctactatccttatcggatcggacactccaacgaacggccaagtagactactacccgaggcctaggttccaaggttcggacgtacgggtttgggtaccgtaggggactaacgggtacgtttccaccgtttaccgtccaaccgtagttacccgagtaccgtaaccggtcccgttacgaccgtacggttaccgtaagggtaaacgttaacgttttttacggaaaccgttttaaaacgtttttaacgtttaaccgttacggttaacctaacgggtaaccttaaacgggtttaaaaccttaaaaccgtttaaaccgggttaccgggttaacccccgttttaacccgggttaaaccgttttaaacccggtttttaaccggggaacccgggttaaaccggggggtaaccgtaaacggggttaaccggttaaccgggtaaagggttaaaccccgttaaccggtaaaaaccggttaacgggtttaccggggtaaccgggtaacccgtttaaccgggtaccccgtaaaccgtttaaccgg

SEQ ID NO: 69513 - DNA, 578 bp, Homo sapiens
  misc_feature: GYAE6OF02I7DBK.51.76.G10.1.454.CMB.1.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgttagcagcgacttagcctggtaccagcaagaacctggccaggctcccgaggcctcctnatctatgatgcatccacgaaggccatgatactccagcctaggttcagtggcaggtgggtctgggacnggtacgttccactccactaccatacagcgacgtccgtgactacgtctaaggtaagtttatttagacttaacttttattacctagtacagtactaagttaactaactaacgttcggtacccttaccgttacgttacgtttacggaccgtacgggaacctaagggcgtaggtaacgtacgttaaccggtaaacgttacgtaggtacggtctacggacctaccgtacg

SEQ ID NO: 69514 - DNA, 668 bp, Homo sapiens
  misc_feature: GYAE6OF02JRJJK.51.76.G10.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangccaccctctcctgcagggccagtcagagtgtagcagcgacttagcctggtaccagcagaacctggccaggctccaggctccncatctatgatgacatccacgaagggccactgactactccgagtcctaaggttcagtggactagggtgggtcacggggacaggtacgttcacgttcctccaacctagtacgaggaccgacgtccccgtagacctaggtaccgtagtaaacgttagtttacgtacttaacgttttaacgtttacgttacggttacctaacgttaacgtaacgtttaaacgtaaacgtttaaccggttaccggttaccctttaaccggttaacccttaccgggtttttaccggtacccgggtaacggggtaacccttaaacggtccggttaagggtaaccgtacgttaacccgaaacggttaacgttcggtacggtaccgtacggtaccgtaaccgttacg

SEQ ID NO: 69515 - DNA, 590 bp, Homo sapiens
  misc_feature: GYAE6OF02I60ZT.51.76.G10.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgacttgcctgtaccagcagaacctggccaggctccaggctccncatctatgatgcatccacgaacgggccactgatactcccagcctaggttcagtcggcaggtcgggtctagggactagtagttccacttcgtaccactatacagacacgtcctcgctagtcgtagaagttattttagacttaattttacgttacttagtactagtactaagttaactaaagttaaccgtcgggtacccttaccgttaccttacgtttacggaccgtacgggtaacccgtacgtccggtaggaacgttacgtaaccgtaaaccggtacgttacggtacggtcgtacggtaccctacgtaaccg

SEQ ID NO: 69516 - DNA, 557 bp, Homo sapiens
  misc_feature: GYAE6OF02FRU7R.51.76.G10.1.454.CMB.1.raw
  modified_base (196)..(196): a, c, t, g, unknown or other
  misc_feature (196)..(196): n is a, c, g, or t
  modified_base (363)..(363): a, c, t, g, unknown or other
  misc_feature (363)..(363): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccaggctcctcatctatgatgcatccacaagggccactgatactcccagccaggttcagtggcaggtgggtctgggacagtagttcactcncaccatcagcagcctgcagtctagaagtattttgacttaatttattactgtactagactagttaataattaacgttcggtacccttaccgttaacttaccgttttcggaccgtacggggtaacctaacggtcgtagggacgtaacgttaccgaaaccgtaacgttcggtacggtaccgtcgtacctaccgtacg

SEQ ID NO: 69517 - DNA, 602 bp, Homo sapiens
  misc_feature: GYAE6OF02HY6MI.51.76.G10.1.454.CMB.1.raw
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccctaccctgtctgtgtcctaccgaagggggaaaactagccctacccttctcctgccagggcctagtcaagagtgttagcagcgattagctggaccagcagaacngcaggctccagcncctnatctatgatgcatccaacaacgggccacgtgatacncccagccaggttcagtggcaggttgggtcgtcggggacacgtaggttccaacgtcctaccgactacgtcgagaccgacgtcctgacctaggtacctaggtaaacgttagttttacggacttaaagttttacttacgttcgtacgtagtaccgtaagttactaaacgtaacgtcggtaaccttcccggtaacttacgttttacgggaccgtacggggtaccaaggtcgtaggagaacttaacgaaacgacgttcggtaggtacctggtacctactacg

SEQ ID NO: 69518 - DNA, 730 bp, Homo sapiens
  misc_feature: GYAE6OF02IG4WC.51.76.G10.1.454.CMB.1.raw
  modified_base (196)..(196): a, c, t, g, unknown or other
  misc_feature (196)..(196): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctccaggctcctcatctatgatgcatccanaacgggccaacgtgactactcccagccaggttccaggtcggacaggtgggtctaggggacaaggtacgtttaccgaccttccgtaccaaccctaacgttccgaacggccgtaacggacccgttcggaccgtacggttaccgttaggtaaagttaacgtttttacggtactttaaaagtttttaacgtttaaccgttagttaccgtaagtaccgttaaaggttaactttaaacgttaaaccgttaccggttaccccgtttacccggttaaccgtttaaccggttttttaccgggacccggttaaccgggggtaaccccgtaaacgggtaccggttaacgggaacggttaaccgttaacccggtaaaaaccggtaaccggttacgggttaccgggttaccgttaaccggtacccgttaacccgttaaccgg

SEQ ID NO: 69519 - DNA, 552 bp, Homo sapiens
  misc_feature: GYAE6OF02HDHRM.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacagggccactgatactcccagccaggttcagtggcagtgggtctgggacagtagttcacgtctcaccatcagcagcctgcagtctgagtattttgacttaatttattactgtacagtacgagttaataaacgttaactcggtaccttacccggttaccttaccgttttcgggacccgtagggggaaccctaaggtccgtacggagtaacgtacgtaaacgaacgttcggtaggtctacggacctaccgtacg

SEQ ID NO: 69520 - DNA, 614 bp, Homo sapiens
  misc_feature: GYAE6OF02JZS5C.51.76.G10.1.454.CMB.1.raw
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (393)..(393): a, c, t, g, unknown or other
  misc_feature (393)..(393): n is a, c, g, or t
tcagcgatcgtatacacgaccggtgctcgatttagtcactcatacaggggaggaacgtgctcagttaggacccagacggaaccatggaagccccagcgcagcttctcttcctcctgctactctggctcccagataccactggagaagtagtgatgacgcagtctccagccaccctgtctgtgtctaccgaggggaagccaccctcgtcctgcagggccagtcagatcgtagcagcgattagcctaggtacagctacgaactggccagcctacccaggtcctccgtanacgtcatcgatgcntaccagtaacggtcactgactactccgagcctaggttcaggttgacgtggtacgggtcgtaggacctaggtacgttacacgtctacgactanacgacgcacggtacctcggtacgacgttacgacgtaaacgttcgtttaccgatttaacgtttacgttacgttaggttaaccacgttaccgtaagttaacttacgtaaaccggttcgtacccgtttacgtacgttaccgtttacgccgttacgggacctaacggtcggtaagtacgtacgttaaccgaacgtacggtagtacggtacgagtacccagttacg

SEQ ID NO: 69521 - DNA, 813 bp, Homo sapiens
  misc_feature: GYAE6OF02JL8VQ.51.76.G10.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
tcagcgatcgtatacacgaccggtgctcgatttagtcactcatacagggggaggaacgtgctcagttaggacccagacggaaccatggaagccccagcgcagcttctcttcctcctcgctactctggcctcccagactaccactggagaagtagtgatgacgcagtctccagccaccctgctgtgtctcaggggaanacgccaccctcncctgccgagggccctaggtcacggtagttcggttagcaggccgtagttagccccttgggaaccctagccagaaacccgtggaccagggcctccccgaggtccctccgtacctactccgtactggtaactcggtccacgttcccgaaaccggtaacggggccctacggtacgttaaacgtactccccccggtaaggtcccccgtaagggtttacccgagggttaccgggacggttaacgggtttgggggttaccgttagggggaaccctagggttaaccggtttccaacgtttccgttaacccaaccgtacgttacgaaccgtccgaaccggccgttacggtacgtacgtacggttaacgtaaacgttattttacggtaactttaagttttaaccttacgttacgtacgtaacgtaccttagttaaacgttacttaaaccgttccgggttaacctttacccgtttaacgtttaacccgtttaaccgggtccccgggttaacggggtaacccgtaagggttacccggttaagggtaaacgtacgtaaaccggttaaaaacggtacgttaccgggtaccggttacgtacggtacctaaccccgtaag

SEQ ID NO: 69522 - DNA, 492 bp, Homo sapiens
  misc_feature: GYAE6OF02HRNL6.51.76.G10.1.454.CMB.1.raw
  modified_base (196)..(196): a, c, t, g, unknown or other
  misc_feature (196)..(196): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccatgatatcccagccaggtcagtggcaggtggctgggacagagttcacttctcaccatcagcngcctgcagtctagagtatttgactaatttattactgtcagtacagtataataacgtgtcctcgtactactttgcgtagggacctaagctggagtactacaaacgactggtgctcgcactacg

SEQ ID NO: 69523 - DNA, 750 bp, Homo sapiens
  misc_feature: GYAE6OF02HVEDF.51.76.G10.1.454.CMB.1.raw
  modified_base (220)..(220): a, c, t, g, unknown or other
  misc_feature (220)..(220): n is a, c, g, or t
tcagcgatcgtatacacgaccggtgctcgatttagtcactcatacagggggagaactggctcagttaggacccagacgggaaccatcggaacgccccaggccgcgagcttctcttcctcctgcctactctggctcccgagataccgacgtgggacgaagtagtgactgacgcagtctccacgccctacccgtgtcgtgtcgtacgtaccgagggggaaancgtcccaccctctcctgcagggccaggtcagagtgttaacgcagcgtacttaagcctgtaccacgcaacggggggaacctacggaccgacggaccgtacccgaacggacccttacctactactacttaattacgtagtacgactactaccaacgtacggacctacgtacgtaactactacccgacgtccgtacggtcgtacggtcggacgtaggtcgggtacgtacgggacgtacgtacgttacctacctacctaccgaccgtacgtacgacgacgacgtccgtagaccgtagtcgtagtaacgttagtttacgtacttaactttaacgttacttacgtacgtacgtacgtaagtaactaaacgtaaccgtacggtacccgtttaccggttaaccgttaccgtttttaccggggacccgggtaacgggtaacccgtaacggtccggtaacgggtaacgtaaccgtaaccggtaaaccggtaaccggttacggtacggttaacccggtaccgtaccccgtaccgttaaccc

SEQ ID NO: 69524 - DNA, 533 bp, Homo sapiens
  misc_feature: GYAE6OF02H99OG.51.76.G10.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (354)..(354): a, c, t, g, unknown or other
  misc_feature (354)..(354): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaanagccaccctctcctgcagggccagtcagngtgttagcagcgattgcctggtaccagcagaaacctggccaggcctccgaggcctcctcatctatgatgcatccaacgaacgggccacgtgaactactcccagcctaggtccagtcggctaggtggtcngggacagtagttcactctccacactcacgcacgctgctagtctagaagttatttgtacttaatttattactgtacagtactagtactaataactcgtaccttccgtactacgtttcgaccgacgggaacctaggcgtaggacgtactaacgaacgtacgtcggtgctcgtaccactacg

SEQ ID NO: 69525 - DNA, 689 bp, Homo sapiens
  misc_feature: GYAE6OF02IY7HB.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaacctggccaggcctcccgaggcctcctcatctatgatgcatccaacgaacgggccagtgactactcccagccaggttcaggtggctagggtgggtcgtaggggacagggtacgttccaccttccgtaccaacctactaccgacgaccgacgtcccgtgccgtaggttccgtaggtaaagtttacgtttttacggtacctttaaatttttaacgtttaacgttcggttacgtaacgttacgttaaggtttaacttaaacgtttaaccgttacgggttacccctttacccggttaacctttaaccggtttttaccgggacccggtaacgggggtaaccctaaggggttcccgttaggggtaaaccgtaacgttaaccgtaaaaccggtaacgttcgggttacggtaccgtacggtaccctaacccgttacg

SEQ ID NO: 69526 - DNA, 542 bp, Homo sapiens
  misc_feature: GYAE6OF02HO9QR.51.76.G10.1.454.CMB.1.raw
  modified_base (196)..(196): a, c, t, g, unknown or other
  misc_feature (196)..(196): n is a, c, g, or t
  modified_base (416)..(416): a, c, t, g, unknown or other
  misc_feature (416)..(416): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgttagcagcgacttagcctggtaccagcacgaaactggccaggctcccgaggcctcctcatctatgatgcactccacgaacgggccactgatactccagccaggttcagtcggcaggtggtcgtgggacagtacgttcactctcaccatcgagtcacgcctgactagtctaggtatatttgactaatttntactgtacagtctaagtaataactacgtcgtaccttaccgtacttacgtttacggaccgtacggggtaccaaggtcgtaggtatacgtaaccgaacgtacgtggtacgtcgtacgaccgtactacg

SEQ ID NO: 69527 - DNA, 566 bp, Homo sapiens
  misc_feature: GYAE6OF02FVZQ7.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaagagccaccctctcctgcagggccagtcagagtgttagcagcgacttagcctggtaccagcagaacctggccaggctcccaggcctcctcatctatgatgcatccaacgaacgggcccacgtgatactcccagccgaggttcagtcggcaggtgggtcgtgggacaggtacgttcacttccacaccatcagcacgcctgctagtctagtaagtattttgacttaatttacttacttgtcagtactagttataacttaacgtcggtccttaccgtacttaccgtttacggacccgtacgggtaccgtaaggtcgtagggacgtaacgtacgaaaccggtacgttcggttacggtccgtacgtaccgtacctacg

SEQ ID NO: 69528 - DNA, 873 bp, Homo sapiens
  misc_feature: GYAE6OF02ITPS3.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtgtctcgaggggaaanagcccaccctctcctgcgagggccagtcagtagtgttacgcagcgtacttagcctggtaaccagaccaacgaaaccctgggaccccaagggtccctaccccgaggtcccttccctactaatttccgtaagttgtaacgttcggcctaactaccccgaaaccggaacggggtaccctaaccgttaggaaactttaacccgcccccgaaaggtacccccgttaaaggggttttaccaaacggggtttcgggacccgtaagggggttttcgggggccggttaacgggggtaaaccgttaaggtaccgggtttttaacccaaccggtttaccccgttaacgaaaccctacttaacccgaacggacccgtaaccggtcccgttacgggtacaacgttaccggtaacggtttaaacggttaacgtttttacgaaacgtttaaacttttttaaccgttaacggttacgttaccgtaacgtacgttaaaacgttaaacgttaaacgttaaccgttaccggttaaccccgttttaaccggtaaccgttttaccgggttttaaccgggacccgggtaacggggtaaccgtaaccgggtacgggtttaacggaacgggttaaactaaaccggttaaacggtaacggttacggttaccgggtacctaaccggtaccctaacgttaccg

SEQ ID NO: 69529 - DNA, 545 bp, Homo sapiens
  misc_feature: GYAE6OF02HG6GA.51.76.G10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagngtgttagcagcgacttagcctggtaccagcagaaacctggccaggctcccaggctcctcatctatgatgcatccacaagggccactgatatcccagcccaggttcaggtggcaggtgggtctgggacngtagttcgactctcaccatcagcagcctgcagtctgaagtattttacgacttaatttattacttgtactagacagttataagttaactcggtaccttaccgtactacgtttcggaccgtacggggaccaacggtcgtaggtacgtaacgtaccgtaaacgtacgtacggtaggtacgtcggtaccacgtaacg

SEQ ID NO: 69530 - DNA, 603 bp, Homo sapiens
  misc_feature: GYAE6OF02H1KY0.51.76.G10.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccacctgtctgtgtctccgaggggaancgccaccctctcctgcagggccagtcagngtgttagcagcgacttagcctggtaccagcaacgaacctggaccaggcctcccgaggcctcctcatctatgactgcactccacgtaacggccagtgtactactcccagtcctaggttcgaggtcgcgtaggtcgggtacgtagggactaagtcgttccacctctaccaacctatccgagtccgtacgccctgacgtacgttcgtagtaagttcttttacggtacttaattttacttgtacgtactagtacctaagttaacttaacgtacgttcggtacccttacgttactaccgtttcgggacccgtacggggtacctagggcgtaacggtacgtacgtaaccgtaaacgtacgttcggtcgaccgtacgccgtactacg

SEQ ID NO: 69531 - DNA, 531 bp, Homo sapiens
  misc_feature: GYAE6OF02IGPS1.51.76.G10.1.454.CMB.1.raw
  modified_base (196)..(196): a, c, t, g, unknown or other
  misc_feature (196)..(196): n is a, c, g, or t
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttgcctggtaccagcaagaaacctggccaggctcccgaggcctcctcatctatgatgcatccaacgaagggccctagtgactactcccagccctaggttcagtggcaggtggtcngggacagtnttcactctcacactcancacgcctgcagtctgaagtattttcgattaatttacttactgtacagtctaagtataatacgtacgtccttacgtcttacgtttcgacgtacgggaccaggcgtaggacgtactaccgaaacgacgttggtacggtcgtacgacacctacg

SEQ ID NO: 69532 - DNA, 653 bp, Homo sapiens
  misc_feature: GYAE6OF02G4KHE.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangcccaccctntcctgcagggccagtcagagtgttagcagcgtacttagcctggtaccagcaagaaacctggaccaggctcccaggcctccncatctangatgcatccaacgaacgggccagtgaactacgtcccagtccaggtttccaaggtcgcgaggtttcgggtacgtgggaaactaggtacgtttccacttccgtaccacctaagttcccgaagtaccgaacggtcccttaggaccgtaacgttccgtaaggtaaacgttagtttttacgaacgtttaaatttacttaacgttgtaccaagtactaagttaacttaacgtaaccgtcgtacccttaccggtaaacttacgtttacgggacccggaacgggtacctaacggtcggttaagggtaactaaccgttaaaccgaaacggtacgttcggtacggtaccttaggacccctaacgttacg

SEQ ID NO: 69533 - DNA, 548 bp, Homo sapiens
  misc_feature: GYAE6OF02G2KG4.51.76.G10.1.454.CMB.1.raw
  modified_base (197)..(197): a, c, t, g, unknown or other
  misc_feature (197)..(197): n is a, c, g, or t
  modified_base (345)..(345): a, c, t, g, unknown or other
  misc_feature (345)..(345): n is a, c, g, or t
  modified_base (395)..(395): a, c, t, g, unknown or other
  misc_feature (395)..(395): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcagaaacctggccaggctcccaggcctcctcatctatgatgcatccacgaggccatgatactcccagccaggttcagtggcaggtggtcngggacaggagttcactctcacatcagcacgcctgctagtctagtaagttnttttagacttaatttacgttactgtactagactagtacttaataacgtcgtacctccgttacttacgtttcggaccgacggggtaccaacggtcgtaggtaacgaacgttaccgaaacggtacgtaggttccgggactacgtaccaccttacg

SEQ ID NO: 69534 - DNA, 558 bp, Homo sapiens
  misc_feature: GYAE6OF02JFAG1.51.76.G10.1.454.CMB.1.raw
  modified_base (196)..(196): a, c, t, g, unknown or other
  misc_feature (196)..(196): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggaccaggcctcccgaggtcctcctcatctatgatgcatccacgaggccatgatacnccagccaggttcagtgcaggtggtcngggacagtagttcnctctcactactcacgcacgcctgcgtagttacgtagtaagttatttgacttaaatttacttacttgtacagtactaagttaacttaaacgttaacgttacgggtaccttaccgttacttaacgtttcgggaccgtacgggacctaggtctagggaactagtaaccgaaacgtacgtcgtacgcgtacgtacctacgtac

SEQ ID NO: 69535 - DNA, 771 bp, Homo sapiens
  misc_feature: GYAE6OF02JOWVV.51.76.G10.1.454.CMB.1.raw
  modified_base (331)..(331): a, c, t, g, unknown or other
  misc_feature (331)..(331): n is a, c, g, or t
tcagcgatcgtatacacgaccggtgctcgatttagtcactcatacaggggagggaactcgctccaggttaggaccccagacggaacctatggaagtccccagcgcagcttctcttcctcctgctactctggcctcccagattaccgactggagagtagtgatgacgctaagtctccagccacctggtctgtgtctcgaggggaagtacggccacctctcctgcgaggggccctagtccagtacgtgttacgcacgacgtacttacgccgtggttaccagtacaagtaaaccgttggacctaaggcctacccgaggccgtcctcatcctagnggacgtcgctacttccgaacgacggtaccacgttagacttacgacccgagtcccgtaggttcaagttcggactaggtcgggtacgtacgggactaacgggtacgttaccgacgttacccgtacgaacccgtacgtaccggtaacggtaccgtaacgtacccgttacgaaccggtaaccgtttaccgtacggtaaacggtttagttttacccggaactttaaacgttttaaagttaccgtacggttaccgaaacggttaccgttaaacggttaaaccgttaaacgttaaaccggttccgggttaacccgttccgtttaaacgttacggttttacggaccccggtaggggttaaccctaacggtacggttacgggtaactaacgttaaccgtaaacggttacccgttggtaccggtaaccgtacgtaccgttaccggtaacg

SEQ ID NO: 69536 - DNA, 751 bp, Homo sapiens
  misc_feature: GYAE6OF02FWX12.51.76.G10.1.454.CMB.1.raw
tcagcgatcgtatacacgaccggtgctcgatttagtcactcatacagggggtagggaactgctcagttaggacccagacggaaccagtggaagccccagccgcagcttctcttccgtcctgctactctggctcccagataccactggagagtagtgatgacgcagtcctccagcccacctgtcctgtgtctccgaaggggaagagcccacccgtctcctgcacgggccaggtcgagagtgtaagctagcgtacttagccttggtaccagacaagaaaccgtggaccgacggcctacccgaggtccttaccctcacttctacttggactcggcctaacgtcccgaacgtaaagggggcccctaacgtagaacttaccgtccccgaaggtcccgtaaggtttcgagggttacggccgtaagggtttcggggtcgttacgggacgtaagtccgttacaccgttacctaccaccgtataccgacggcgtaacggtccttacgtacgtaccgtcttaaggtaacgtttagttttagaccgtttaaagttttactttaacgtttgttaacgtacggttacgaaccgtaacggttaaaaccctacggttaccggttaacccgttaaccggttacggtaaccggttaccgggaaccggttaacgggaacccggtaaggtaaccgggtaaacttaccggtaaaaccgttaccgtagggttaccgtaccgtcgtaacccgtaccgttacgttccgttaccg

SEQ ID NO: 69537 - DNA, 758 bp, Homo sapiens
  misc_feature: GYAE6OF02JIERN.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgccagggccagtccagagtgttagcagccgtacttagcctggtaccagcaacgaaaccgtggccaggcctacccgaggcctcctacatcctagtcgatcgcactccaacgaacgggtccaacgtgtactactaccccgagcccgtaaggtttcaaggttcgggaccgtaggttcggggtcgtaggggtaaccaggtacgtttaccgaacgttccctacgtacccgtacgtaccgacgccaacgtcccgtagacgtaggtacctaggaacgtttagtttcggtacctttaaatttacgttacgtttagttaccgtacgtaaccgttagtttaaccgttaaacgtttaaccgttccgggttaaccctttaccccggtttaaaccgtttaccgttttttaacccggggacccggtttaaccgggggaaccgttaaaccggttacggtttaacgggtaaacggttaaccgttaaaccggtaaaaccggttaaccggttacgggttaaccgggtaccgttaacccggtaacccggtaacccgtttaaccgg

SEQ ID NO: 69538 - DNA, 600 bp, Homo sapiens
  misc_feature: GYAE6OF02H2568.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaanagcccaccctctcctgcagggccagtcagagtgttagcagcgacttagcctggtaccagcagaacctggccaggctcccgaggctcctcatctatgatgcatccacgaacgggccaactgtactactcccgagccaggttcgaggttcggacgtaggttcgggtcgtagggactaaggtacgtttacactcctacgaacctataccagccgaacgcctgcagtctagtaagttatttgacttaactttattactaggtacagtactaagtaactaagttaacgtcgtacccttccgtaacgttacgtttcgggacccgtacgggggtacctaacggtcgtaagggtacgtaacgttaaccgaaacggtacgttaggtacggtaccgtacggacctacgttacg

SEQ ID NO: 69539 - DNA, 501 bp, Homo sapiens
  misc_feature: GYAE6OF02GU979.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtggtctgggacagagttcactctcaccatcagcagcctgcagtctgaagtattttgactaatttattatgtcagtcagtataataacgtcgtcctaccgtactacgtttggaccgtagggaccagcgtagagatacgaacgtacgtggtagctcgacactacg

SEQ ID NO: 69540 - DNA, 621 bp, Homo sapiens
  misc_feature: GYAE6OF02JXR32.51.76.G10.1.454.CMB.1.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcaagaaacctggccaggcctcccgaggtcctcctcatctatgactgctactccacgaacggcctagtgactactcccagccgtaggttccaggtcgacgtaggtggtacgnggacagtacgttcactcgtaccacctatcgacgcgacgccgtgacctagtccgtagtaagttctttacgatttaaagtttacttacgtcgtaccaggttactaagtttaaactaacgtaaccgtcgtacccttacggttaacctacgggtttaccggaccggtacggggtaacctaacggtcggttaacggtaagtaaccgttaaccgaaaacggttacggttacggtaccgtacgttaccgaccctaccgttacg

SEQ ID NO: 69541 - DNA, 560 bp, Homo sapiens
  misc_feature: GYAE6OF02FLAX6.51.76.G10.1.454.CMB.1.raw
  modified_base (196)..(196): a, c, t, g, unknown or other
  misc_feature (196)..(196): n is a, c, g, or t
  modified_base (370)..(370): a, c, t, g, unknown or other
  misc_feature (370)..(370): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcactccacgaacgggccactgatactcccagcctaggttcagtcggcaggtgggtctgggacagtacgttcactcncacatcagcagcctgcagtctagaagttatttgacttaatttacttactgtacagtctaagttaactaaattaaccgtcggtacccttccgttacttacgttttcgggaccgtacggggaacctaagggtccgtagggtaacgaacgtaaccgaaacgtaaccgttggtacggtcgtacgacccactacg

SEQ ID NO: 69542 - DNA, 630 bp, Homo sapiens
  misc_feature: GYAE6OF02IZQ0F.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaanacgcccaccctctcctgcagggccagtcagagtgtagcagcgacttagcctggtaccagcaacgaaacctggccaggcctcccgaggcctcctactagtctatgatgcactccaacgaacggccactgatactcccagccgtaggttcaggttcggctaggtcgggtactaggggacagtacgttcaacgttctacgacctatcgtagcacgtcctgactagtactagtaagttagttttcgacttaagttttacttacgtagtactagtactaagtaacttaaactaacgtcgtaccctttaccgttaaccttacggtttacggaccggtaacggggtaacccgtaacggtcggttaacgggaagtaaccgttaaccgtaaaaccggtacgttacgggttaccggacgttaccggtacccgtaaccttaacg

SEQ ID NO: 69543 - DNA, 644 bp, Homo sapiens
  misc_feature: GYAE6OF02IW6A1.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcacgggccagtcagagtgttagcagcgacttagcctggtaccagcaacgaaacctggaccaggcctcccgaggcctcctcactctaagtgatcgcactaccgaacgaacgggcctaacgtgaactactcccgaacgtcccgtaggttcaggttcggcgtagggtttcgggtcgtacgggaactaggtacgttacctaccgttcctacaacctacgtccaacggtccacggtccctggacgtagttacgtaaggtaaagttcttttacggactttaagttttattaccgttgtactaaggtcttaagttaacttaagtaaccgttcggtacccttcgttaaacgttaccgtttcggaccgtacgggaactacggtcgtaggactaacgttaaccgaaagtcgtacggtacgtacctacggtacctaccttacg

SEQ ID NO: 69544 - DNA, 619 bp, Homo sapiens
  misc_feature: GYAE6OF02HX8CW.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcaagaaacctggccaggcctcccgaggcctcctcatctatgatgcactccagaacggccatgactctcccagtccaggttcaggtggctaggtgggtctaggggacagtacgttcactctcacatcagcacgcctgctagtcgtagtaagtatttacgtacttaattttacttacgtgtaccgtagtacctaagttaattaaacgttaaccgtacggttacccttacccggtttaaccttaccgtttttacgggaccccggtacggggtaacccgtaacgggtccgtacgggaacgtaaccgttaaccgtaaacggttaaccggtacggttacgggtaccgttacggtacccgtaccgttaaccg

SEQ ID NO: 69545 - DNA, 511 bp, Homo sapiens
  misc_feature: GYAE6OF02HKN8L.51.76.G10.1.454.CMB.1.raw
  modified_base (196)..(196): a, c, t, g, unknown or other
  misc_feature (196)..(196): n is a, c, g, or t
  modified_base (424)..(424): a, c, t, g, unknown or other
  misc_feature (424)..(424): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaacctggccaggctcccgaggcctcctcatctatgatgcatcccacgaacgggcccactgatactcccagccaggttcaggtggctaggtgggtctgggacaggtagttcactctcaccatcagcacgcctgctagtctagtaagtatttgacttaatttattactntacagctagtataatactcgcctcgtactacgtttcgaccgtaggacagtcgtaggacagtacgaacgactggtcgctacgcactcg

SEQ ID NO: 69546 - DNA, 556 bp, Homo sapiens
  misc_feature: GYAE6OF02GO2RX.51.76.G10.1.454.CMB.1.raw
  modified_base (197)..(197): a, c, t, g, unknown or other
  misc_feature (197)..(197): n is a, c, g, or t
  modified_base (324)..(324): a, c, t, g, unknown or other
  misc_feature (324)..(324): n is a, c, g, or t
  modified_base (355)..(355): a, c, t, g, unknown or other
  misc_feature (355)..(355): n is a, c, g, or t
  modified_base (409)..(409): a, c, t, g, unknown or other
  misc_feature (409)..(409): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaacctggccaggcctcccgaggcctcctcatctatgatgcatccaacgaacgggccatgactacncccagccgaggttcaggtggcaggtgggtcngggactagtcgttcacgtctacacatcacgcacgcctgctacgtctagaagttntttagacttaatttattacttgtacgagtactaagttaattaataacgttcggtacccttaccgttacttacgtttcgggaccggtacggggtacctaaggtcgtaggacgacgtaacgaacgtacgtggtcgcgtacgaccactcg

SEQ ID NO: 69547 - DNA, 556 bp, Homo sapiens
  misc_feature: GYAE6OF02HEE47.51.76.G10.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctntcctgcagggccagtcagagtgtagcagcgacttagcctggtaccagcagaaacctggccaggctcccaggcctcctcatctatgatcgcatccacgaacgggccaactgaatactcccagccaggttcagtggactaggtgggtctggggactaggtacgttcacgtctacaccatcagcacgcctgcagtctagaagtagtttgacttaatttattacttgtactagtacgtaagttactaataacgttacgtaccttaccgttacgtacgttttcggaccgtacgggacctaaggtcgtaggacgtaacgtacgaacgtacgtcggtagtacgtagtaccacgtacg

SEQ ID NO: 69548 - DNA, 581 bp, Homo sapiens
  misc_feature: GYAE6OF02HYTJZ.51.76.G10.1.454.CMB.1.raw
  modified_base (197)..(197): a, c, t, g, unknown or other
  misc_feature (197)..(197): n is a, c, g, or t
  modified_base (352)..(352): a, c, t, g, unknown or other
  misc_feature (352)..(352): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggccaggctcccaggctcctcatctatgatgcatccacgaacgggccacgtgatactcccagcctaggttcaggtggcaggtgggtcngggacaggtacgttcactctcaccatcagcagcctgctagtctagtaagtatttgacttaatttattacttgtacgagtacgtaagttaataaacgttaactcggtaccttaccgtacgttacgttttcgggaccgtacggggtacccgtaacggtcgtacgggtaagtaacgttaaccgtaaacggtaacgttacggtacgggtaccgtacggtacctaccgtaaccg

SEQ ID NO: 69549 - DNA, 776 bp, Homo sapiens
  misc_feature: GYAE6OF02GVQMH.51.76.G10.1.454.CMB.1.raw
  modified_base (223)..(223): a, c, t, g, unknown or other
  misc_feature (223)..(223): n is a, c, g, or t
tcagcgatcgtatacacgaccggtgctcgatttagtcactcatactagggggaggaacgtgcgtcaccgttacggacccgtacgacgggaacctatggaagtccccagcgcagcttctcttcctcctgctaactctggctcccagattaccgactggagaagtaggttcgattgacgtcttaaggtctcccagtccaccgtggtctgtgtctcgaggggaaancgccgacctctccgtgcgacgggccgtacgtcgagagtcgttacgcaggcgtacttacgccgttggtaacctagccgtaagaaaacccgttgggtaccctaaggggccttaccccgagggtcccttacccgttcgaacttccgtagtcgtacgtacgggacaacttccgaaacgaaggggtccctaacttacggtaacttaacgttaccccgaaggtaccctaagggttaccaaaggttacgggaccttaagggtttcggggttacgtacggggtaaacctaagggttacgtttaccgacgttaccgtaccgaaccgtattccgaacgtacgtaccgtcccgttacggactaacggttaccgtaaggtaaacgttacgttttcgaacttttaaattttactttacgtagttaccgagtaccgtaagttaacgtaaacgttaaccgtcggtacccttaacggtaccttacgtttcggaaccgtacgggacctaaggtcgtagggaacgacgttaaccgaagtacgttggtacggtcgtacggtaccgacgtacg

SEQ ID NO: 69550 - DNA, 547 bp, Homo sapiens
  misc_feature: GYAE6OF02FMU0Y.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgacttagcctggtaccagcagaaacctggccaggctcccaggctcctcatctatgatgcatccacaagggccactgactatcccagccaggttcagtgcagtgggtctgggacaggtcttcactctcaccatcagcagcctgcagtctagaagtattttgacttaattttaacttactgttaccagtacaagttaataattaactcggtaccttaccgttactacgttttcggaccgtacgggacctaaggtcgtaggaacgtaacgtaacgaaacggtacgttacggtacggtctacggacctacgtacg

SEQ ID NO: 69551 - DNA, 752 bp, Homo sapiens
  misc_feature: GYAE6OF02IAPJK.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttagcagcgacttagcctggtaccagcaagaacctggccaggctccaggctcctcatctatgatgacatccaacgaacgggccaacgtgaacttactccccgagcccgtaaggttcaaggttcgggacgtagggttcggggttacgtaggggactaaggtacggtttaccaccgttccttacccgaaccctaacttaccgaacggaccgacggtcccttacggtacctacggttaccgttaaggtaaacgttagttttttacgtactttaaaattttttaacgtttaccttaggttaccgtaaggttaaccgttaaagtttaacttaaaacgtttaaacccggttacgggttaaccccgtttacccggttaaaccgtttaaccgttttttaccggggaccccggttaaaccgggggaacccttaaacgggttccggttaaggggtaacgtaacccgttaaaccgtaaaccggtaacggttacgggttaccggtaccgttacccggtaccgtaacccgtttaaccg

SEQ ID NO: 69552 - DNA, 552 bp, Homo sapiens
  misc_feature: GYAE6OF02FTJSS.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggagggaactgactcagttaggacccagacggaaccatggaagccccagcgcagcttctccttcctcctgctactctggctcccagataccactggagaagtacgtgatgacgcagtctccagccaccctgtctgtgtctccgaggggaacncgccaccctctcctgcagggccagtcagagtgtagcagcgtacttagcctggtaccaggcagaaacctggacctaggtctcccaggctcctcatctatgatgcatccacgaggccatgatactccagcctaggttcagtggcaggtcggtctgggacagtagttcacgtctcacctatacagtcacgtcctgcagtctagtaagtatttgacttaatttacttactgtacagtctaagttactaattaacgtcgtacctacgttactacgtttacggaccgtacgggacctacggtctagggtacgtacgtaaccgaaacggtactggtacggacgtcgaccgtactaacg

SEQ ID NO: 69553 - DNA, 869 bp, Homo sapiens
  misc_feature: GYAE6OF02HRWN7.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgattagcctggtaccagcaagaaacctggccaggctcccgaggcctcctcatctaatgactgactactcccaacgaacgggccctaagtcgtaactacctacccgaagtcccgtaaggtttaccaagggttcggacgtaaggggtttcgggtacgttaggggacctaagggtacgtttacccgaccgttaccgttaccgaacccgtaacgtaccgaaccggtaccgtaaccggtcccgtacggtaccgttaacggttaccgttaacgggtaaacgtttaacgtttttacgggttaaacctttaaagtttttttaaccgtttaaccgtttacggttaaccgttaacgggttaaccgttaaacggttttaaaacgtttaaaaccgttttaaaacccggtttacccggggtttaaacccccgttttaaccccgggtttttaaacccggtttaacccgggtttttttaaccggggaaccccgggttaaaccggggggttaaacccgtaaaccggggttaaccgggttaaccggggtaaacggttaacgttaaaccccggtaaaaaccggtttaaccgggttaccgggttaaccgggtacccgtttaacggtaccccgttaacccgtttaacccgg

SEQ ID NO: 69554 - DNA, 770 bp, Homo sapiens
  misc_feature: GYAE6OF02JW9FY.51.76.G10.1.454.CMB.1.raw
  modified_base (151)..(151): a, c, t, g, unknown or other
  misc_feature (151)..(151): n is a, c, g, or t
  modified_base (194)..(194): a, c, t, g, unknown or other
  misc_feature (194)..(194): n is a, c, g, or t
tcagcgatcgtatacacgaccggtgctcgatttagtcactcatacagggggaggaactgctcagttaggacccagacggaaccatggaagcccagcgcagcttctcttcctctgctactctggctcccagactaccactggagaagtagtnatgacgcagtctccagccacctgtctgtgtcctcgaggggaanacgcccacctctcctgcgtacggccagtcagtagtgttagcaggcgtacgttagccgttggtaccaggcaacgaaactggccaggcctacccgagggtcccttaccgactacttcgtaacgtcgtacgttacgacctaacgttcccgaaacgggtaaaccgggtccctaaacgtacgtaacggttaccaaccccgtacggtaccgtacggtttcacggttcggacgtagggtcggtcgtagggactagtacgttacgacctacgtccacgtacgttacgacgtaccgtacgtaccgtacgtacgttacggtaccgttagtaacggttaacgtttacgtaactttaaacggtttacgtttaaaccgttcgttaaccgtacgtaacgttaacgttaacgttaaaccgtacggtaaccgttaccgttaacccgttaaacgttaccggttttaccggaaccggtaacgggtaaccgttaaccggtacggttaaccgggtaacgtaaccgttaaaccggtaaaccggttaaccggttaacggtaccggttaaccggaccggttacccgtaccgttaaccgg

SEQ ID NO: 69555 - DNA, 530 bp, Homo sapiens
  misc_feature: GYAE6OF02GNM0K.51.76.G10.1.454.CMB.1.raw
  modified_base (196)..(196): a, c, t, g, unknown or other
  misc_feature (196)..(196): n is a, c, g, or t
  modified_base (320)..(320): a, c, t, g, unknown or other
  misc_feature (320)..(320): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggcctcccaggctcctcatctatgatgcatccacgaacgggccactgactacncccagcctaggttcagtggcaggtcgggtcngggacagtacgttcactctcaccatcagcacgcctgctagtctagtaagtattttagacttaaattttatactgtacagtactagtataactacgtgtaccttcgtactacgtttcggaccgtagggacctagtcgtaggtacacgtacgaaacgtacgtggtacgtctcgaccactac

SEQ ID NO: 69556 - DNA, 654 bp, Homo sapiens
  misc_feature: GYAE6OF02F0MEC.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgtagcagcgacttagcctggtaccagcagaacctggaccaggcctcccgaggtcctcctcatctatgatcgacatcccaagacgggccagtgactctcccagccgtaggttcaggtcggctaggtgggtcgtgggacaggtacttccacttccacacctactacgacgcgtacgcctagacctacgttacgtagtaaagttgttttaacgactttaaattttacttaacgttagtaccgtaaggtacctaaggtttaacttaaacgttaaccggttaccggttacccttaaccgtttaccgttacgttttaccgggaccggtacggggtaaccctaacgggtaccgtaacgggtaacgtaaccgttaaccgtaaaacggttaccggttaccggttacgggaccttacggtaccctaccgtaccgg

SEQ ID NO: 69557 - DNA, 620 bp, Homo sapiens
  misc_feature: GYAE6OF02HDT4X.51.76.G10.1.454.CMB.1.raw
  modified_base (438)..(438): a, c, t, g, unknown or other
  misc_feature (438)..(438): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccacccctctccctgcagggccaggtcagagtgttagcagcgacttagcctggtaccagcagaaacctggccaggcctccgaggctcctcatctatgatgacactccaacgaacgggcccacgttagaactacctacccaggccctagggtttcaggttcgggcgagggttcgggtcgtgggaacaggtacgttcaccgtcctcacctactcacgcacgcctagcacgtctagaacgttntttacgtacttaatttacttacttcgtactacgtacgtaacgttaattaacgttaaccgtcgtacccgttaccgttaacgttaccgtttacgggcccgtaacggggtaccaacgggtcgtacggtaacgtaacgtaacggtaaaccgtacggttaggtccggtacgtcgtaccgacgttacg

SEQ ID NO: 69558 - DNA, 570 bp, Homo sapiens
  misc_feature: GYAE6OF02G4FYS.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtccagagtgttagcagcgacttagcctggtaccagcagaaacctggccaggctcccaggctcctcatctatgatgcatccacacgggccactgactatcccagcctaggttcagtggcagtgggtctgggacagagttcacgtctacaccatcagcagcctgcagtctagagtattttgacttaattttattacgtgtaccagtctaagttaataaattaacgttcggtacccttccgttaactacgttttcgggacccgtacggggtaaccctaagggtaccgttaggaacggtaacttaaccgaaacggttaacgtgggttaccggacgttcggtacccaccgttaaccg

SEQ ID NO: 69559 - DNA, 582 bp, Homo sapiens
  misc_feature: GYAE6OF02I318E.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggcctcccgaggctcctcatctatgatgcatccacgaagggccactgatactcccagcctaggttcaggtcggcaggtgggtctgggacagtagttcactctacacatcagcacgctgcagtctagtaagtatttagacttaatttacttacttgtacgagtactagttaataaacgttaacgtcgtacccttaccgttaccgttacgttttcgggacccgtacggggtaacccgtaaggtaccgttagggaaacgtaacgttaaccgaaaacggtaacgttcggtacggtaccgtacggtaccgtaccgtacg

SEQ ID NO: 69560 - DNA, 718 bp, Homo sapiens
  misc_feature: GYAE6OF02IKICR.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagagcccaccctctccctgccagggcccagtcagagtgttagcagcgacttagccgtcggtaccagaccaagaaccgtcggaccaggcctccccgaggcctcctcacttctagtcgatcgacctactccgaaccgaacgggtcccactacggtacttacgtaccccaggacccgtaggtttccgaacggttgggacccgagggttcggggttaccggtacggggtaaccctagggtaccgtttcgaacccgttccgtaccaacccgtaagtaccgtaccgaccgtaccggtccctacggcctaacggttccgtaacgtaacggtttaatttacggttactttaaagtttactttacgttcgtaccgtatacgttaacgtaagttaacgttaaccgtaccggttaccttaccgttaaccgttacgttttaccgggaccggtacgggtaaccgtacggtcggttagggaacgtacgtaaccgtaaaccgtacggttcggtacggtccgtacggaccctacgttacg

SEQ ID NO: 69561 - DNA, 517 bp, Homo sapiens
  misc_feature: GYAE6OF02GAWRD.51.76.G10.1.454.CMB.1.raw
  modified_base (196)..(196): a, c, t, g, unknown or other
  misc_feature (196)..(196): n is a, c, g, or t
  modified_base (427)..(427): a, c, t, g, unknown or other
  misc_feature (427)..(427): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaaacctggccaggctcccaggctcctcatctatgatgcatccacaacgggccactgatactcccagcccaggttcagtggcaggttcgggtctggggacaggtagttaccacgtcctacaccatcagcagcctgctagtctgaagtatttgacttaatttattactgtcancagtataatactgcctcgtactacgtttgctacgggaacaggtacgtaggagtaactacgaaacgtacgtggtagtctcgactacctacg

SEQ ID NO: 69562 - DNA, 766 bp, Homo sapiens
  misc_feature: GYAE6OF02I6XA0.51.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcgagggccagtcagngtgttagcagcgattagcctggtaccagcagaacctggccaggcctcccaggcctcctcatctagtgatgcactccgaacgaacgggccctactgaacttacgtaccccgagtccctaaggttccaggtcgggcctagggttcggggttccgtggggaacctaggttacggttccaaccgtttccgtaccaaccctacgtaccgaacgtaccgtaacggtcccgttacgtccgttaacgttccgttaagtaaacggttacgtttttaacggtaacctttaaacgtttttaacgtttaaccgttacggttaccgttaacggtaccgtaaagtttaaacgtttaaacgtttaaaccgttcccggttaacccgtttaacccggtttaaacccgtttaccgtttttaccggggacccggttaacgggggtaaccccgttaaacgggtaccggttaacgggtaacggtaacggtttaaacccgaaaaacggttaccgttaacgggttccgggtaccgtttaccggaccgtaacccgttacccgg

SEQ ID NO: 69563 - DNA, 515 bp, Homo sapiens
  misc_feature: GYAE6OF02HR864.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatactccagccaggttcagtggcagtggtctgggacagagttcactctacaccatcagtcagcctgcagtctagtaagtattttgactaagttttacttaactgtacagtctagttaataataactcggtcctccgtactacgttttgaccgtacgggacctagcgtaggagattacgaacgtactggtagcgtagcacctag

SEQ ID NO: 69564 - DNA, 598 bp, Homo sapiens
  misc_feature: GYAE6OF02HJWFH.51.76.G10.1.454.CMB.1.raw
  modified_base (446)..(446): a, c, t, g, unknown or other
  misc_feature (446)..(446): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccgagggggaaagacgcccaccctctcctgcagggccagtcagagtgttagcagcgacttagcctggtaccagcagaaacctggccaggcctcccgaggcctcctcatctatgatgcatccaacgaacgggccacgtgatactcccagcctaggttcaggtggctaggtgggtcgtggggactaggtagttccacttctaccaccatcagcacgtcctgacacgtcgtagtagttagtttcgtacttaatttattacgtntacgacgtactaagttaactaaagttaacgttcgtacccgttacgttaccgttacgttttacgggacccggtacggggtacctaacggtcggtaggtacgtaacttaaccgaaacggtacgtacggtacggtacgtacggtacctacctacg

SEQ ID NO: 69565 - DNA, 694 bp, Homo sapiens
  misc_feature: GYAE6OF02JW536.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaanacgcccaccctctcctgcagggccagtcagagtgtacgcagcgacttagcctggtaccagcaagtaaccgtggaccgaggcctaccgaggtcctcctactacgtactagtgtacgtcgacactaccccgaaggaacggcccaagttcgaacttaccgtaccccgaggtacccgtaggttaccaagggttcggaccgttaggggttacgggtacgtacgggggaactacggtacgttccgtaaccgttccgtccgaaccttacgtaccgacgtaccgaacgtccgagtacctaggttactaaggtaacgttacgttttacgaacctttaaacgtttacgtttacgtacgttcgaagtaccttaaggttaacttaacgtaaccgttcgttacccttacgttaaccgttacgtttacggaccggttacggacgtacgtcgggtaacgagtaaccgtaacgtaaacggtcgttcggtaacggcttacggacctacgttaccg

SEQ ID NO: 69566 - DNA, 705 bp, Homo sapiens
  misc_feature: GYAE6OF02IRN09.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtcgtctccgaggggaaanacgcccaccctctcctgcagggccagtcagtagtgttacgcagcgtacttagcctaggtaccagcaacgaaacctggccaggcctacccgaggtcctcctctactctagtacgtagtcgactactaccgacgaaacgggcctaacgttgaacttaaccgtacccgtacggaccgtacggttacgtacgggttacggaccgtaggggtttcgggtaccgtacgggggactaacggtacgtttaccaccgttaccgttacaaccctacgtcaacgggacctacgtcccgtacggacgtacgttacgtaacgtaacggtttaattttcggtaaacctttatttttaacttaccgttaggtaccagtaaccgttaagttaaacgtaacgttaaccgtccggtacctttaccggtacgtttaaccggtttacggaccgtacgggtaccgaacggtcgtacggagtaacgtaaccggaaacgtcggtaggtcgacgttacgccgtacttaacgg

SEQ ID NO: 69567 - DNA, 529 bp, Homo sapiens
  misc_feature: GYAE6OF02HQT56.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaacctggccaggctcccaggctcctcatctatgatgcatccacaagggccactgatatcccagccaggttccaggtggcaggtgggtcgtggggacaggtacgttcactctcgaccactcagcacgcctgcagtctgaagtattttagactaatttacttacttgtactagtctagtataataacgtacgtccttaccgtactacttttgccgtacgggaccaagtctacggagtagtacgaacgtacgtaggtagtcgtacgaccactacg

SEQ ID NO: 69568 - DNA, 741 bp, Homo sapiens
  misc_feature: GYAE6OF02G01GG.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagtctggtaccagcaagaactggccaggcctcccaggctcctcatctatgatgcatccaacgaacgggccactgaatactcccagccgtaaggttcaaggtcgggcctagggtcgggtacgtcggggaacaagggtacgtttccaaccgttcctaccaacccgtacttaccgaacggaccgtacggtcccgtacggaccgtacggttaccgtaacggtaaacggttacgtttttacgtaaccgtttaaattttaacgttttaaaccgttcgttaccgtaacgtacgttaaagtttaaacgtttaaaacgttaaccggtttaccggttacccgtttaaccccggttaaccgtttaacccgttttttacggggaacccggttaaccgggggtaacccgttaaccgggttacggttaacggggtaacgtaaccgttaaaccggtaaaaccggtaaacggttacggttaccgggtaccgtaccggtaccgtaacccgttaaccgg

SEQ ID NO: 69569 - DNA, 658 bp, Homo sapiens
  misc_feature: GYAE6OF02I3FN9.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgacttagcctggtaccagcaagaaaccgtggaccaggcctacccgaggtcctcctcattctatgactgacactaccgaacgacggaccacgtgaactacgtacccagtacccgtaggttcacgggttcggacgtacgggttcggggtccgttaaggggaactaagggttacttaccgaaccgttccgtacccaaccgtaactcgaacgccaacggtccctagtacctagttacgtagtaaacgtttcgtttagtaactttaaacgttttacttacgtcgtaacgtaacgtacgttaagttaactaaacgttaccgttacgtacccttacgttaccgttacgtttaccgggaccgacggggaacctaggtacgtaggaacgtacgtaacgaaacgtcgttagaccgtcacgtacctactcg

SEQ ID NO: 69570 - DNA, 570 bp, Homo sapiens
  misc_feature: GYAE6OF02IHGRK.51.76.G10.1.454.CMB.1.raw
  modified_base (194)..(194): a, c, t, g, unknown or other
  misc_feature (194)..(194): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacaggggaggaactgctcagttaggacccagacggaaccatggaagccccagcgcagcttctcttcctctgctactctggctcccagataccactggagaagtagtgatgacgcagtctccagccaccctgtctgtgtctccaggggaaangccaccctctcctgcagggccagtcagagtgttagcagcgacttagcctggtaccagcaacgaaacctggccaggcctcccgaggcctccncatctatgatgcatccacgaacgggccaatcgaatacctcccacgccgtaggttccaggtcggacagggttacgggttcgtaggggacaaggtcgttaccaccgtctaccaccatcgacgcacgtcctgccagtctagtaagttagtttcgacttaattttacttactgtctagtctaagtataacgtacgtcgtaccttacgtacttacgtttacggaccggtacgggtactaggtcgtaggagtaactacgaaacgtacgtcggtacggctacgcctacgtac

SEQ ID NO: 69571 - DNA, 596 bp, Homo sapiens
  misc_feature: GYAE6OF02HQJQ0.51.76.G10.1.454.CMB.1.raw
  modified_base (196)..(196): a, c, t, g, unknown or other
  misc_feature (196)..(196): n is a, c, g, or t
  modified_base (361)..(361): a, c, t, g, unknown or other
  misc_feature (361)..(361): n is a, c, g, or t
  modified_base (436)..(436): a, c, t, g, unknown or other
  misc_feature (436)..(436): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccaggctcctcatctatgactgcatccaacgagggccactgatactcccagcctaggttcagtggcaggttcgggtctgggactaggtnttccacctctaccaccataccagcacgcctcgcacgtctaggtaagtagttttgtacttaattttacttacgttnttacagtacgtaagttaataaacgttaacgttacggtacccgttacccgttacgttaacgtttttaccggaccggtaccggggtaaccgaacggtcgtacgggtacgtaacgttaaccgaaacgtaacgtcggtacggtacgtacgtacctaccgtaacg

SEQ ID NO: 69572 - DNA, 623 bp, Homo sapiens
  misc_feature: GYAE6OF02II297.51.76.G10.1.454.CMB.1.raw
  modified_base (199)..(199): a, c, t, g, unknown or other
  misc_feature (199)..(199): n is a, c, g, or t
  modified_base (333)..(333): a, c, t, g, unknown or other
  misc_feature (333)..(333): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccaccctgtctgtgtctccgaaggggaaanacgcccaccctctccgtgcagggccagtcaggtagtgttagcagcgacttagcctggtaccagcaagaaacctggccaggcctcccgaggcctcctcatctatgatgcactccacgacgggccacgtgactacncccagccaggttcagtcggcgtaggtcgggtcgtgggacaggtacgttccacgtccgtacaacctatccgaacgcacgtccctagcgtacgtacgtaaggtaactttagttttcgtaactttaaagttttacttacgttacgtactagtaccttaaaggttacttaaacgtacgtcggttacccttacgttaacgtttaccggtttacggaccggtacgggtaaccaacggtcgtaagggtaactaacgttacgaaaccgtcgttcggtaccgcgtacgacctacgtacg

SEQ ID NO: 69573 - DNA, 791 bp, Homo sapiens
  misc_feature: GYAE6OF02GDW26.51.76.G10.1.454.CMB.1.raw
  modified_base (215)..(215): a, c, t, g, unknown or other
  misc_feature (215)..(215): n is a, c, g, or t
tcagcgatcgtatacacgaccggtgctcgatttagtcactcatacagggggaggaactgctcagttagggaccccagacggaaccattcggaaggcccccacgcgccagcttctcgttcctccctggctacctctggctcccagataccacttggacgaagtacgtcgatcgaccgcagtctccagccacccgtgtctagtgtctccgagggaancgcctacccgtcgtcctgcagggccagtcagtagttgttagccagcgtacttagacctaaggtaccgacgaccaagaaccctggaccgagcctacccgaggccttccctcctacttcttagtcgaacgtcggaccagtacccgaacgtaacgggccctaaccgtggtaacttaccgtaccccgacggtaccggtacggtttaccgacggtttacggaccgttaaccgggttcgggttacccgttagggggaaaccctaggggttaaccgtttacccgtaccgtcccgttacccgtaaacccgtagttccgaaccgtaccgttacgtaccctttacgtctttacgttaccggttaagaacgttttacgttttaagtacgtttaaactttttaacgttccgttacgttacgtacggtaacgtaaggttaacttaaccgtaacggtccgtaaccccgttaacgttaaacccggtttagtttaccgggacccggttagggaaccctaacggtcgttacggtaacgtacgttaaccgtaaccgttacgttccggtaccggtcctaccgtacctacgttacg

SEQ ID NO: 69574 - DNA, 574 bp, Homo sapiens
  misc_feature: GYAE6OF02GFRI9.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcagaaacctggccaggctcccaggctcctcatctatgatgcatccaacgaaggccactgatactcccagccaggttcagtggctaggtgggtctgggacagtacgttcactcctcaccatcagcacgcctgctagtcgtagaagttatttgacttaatttaacttactcgtcacgtactaagttaactaacgttaacgttcggtacccttaccgttaacgttaccgttttcggacccgtacggggtaaccgtaaggtcgttagggaacgtaacgtaaccgtaaacggtaacgtaggtacggtcgtacgtacctaccgtacg

SEQ ID NO: 69575 - DNA, 828 bp, Homo sapiens
  misc_feature: GYAE6OF02GRIDJ.51.76.G10.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (468)..(468): a, c, t, g, unknown or other
  misc_feature (468)..(468): n is a, c, g, or t
tcagcgatcgtatacacgaccggtgctcgatttagtcactcatacagggggagggaactgctcagttaggacccagacggaaccatggaagccccagcgcagcttctcttcctcctgctactctggctcccagataccactggagaagtagtagatgacgcagtctccagccaccctgtctgtgtctccaggggaanagcccaccctntccctgcacgggccaggtacagacgtgttagcagcgacttagcctggtaccagtcacgaaacgtggaccaggtcctcccgaggtcctacctgacttcgtaatcggtatcggcctactcccaacggaacgggtcccctaagttgactaaccgttccccaggtacccgttagtttaccgaaggtttcggacccgtaagggtttcgggggtacttagggggaaactacggggtactttaccgaccctttccgaccgtaacccngttaacccacggtaccgacggtacccgttacgggacctaacggtttaccgtagggttaacgtttaaggtttttactaaccgttttaaagtttttaacgtttacccggtttaggttaacccgtaacggttaccgttaaaagtttaacgtttaaaacgttaaacggttcccgggttaacccctttaacccgggtttacccgttaaccggttttttacccggggaacccgttaaccggggggttaaccctaaacggggtcccggttaaacgggttaacgggtaaaccgttaaaccggtaaaaccgggttaacgtttacgggttaaccgggtaccttaccgggtaccccgtaacccgttaaccg

SEQ ID NO: 69576 - DNA, 492 bp, Homo sapiens
  misc_feature: GYAE6OF02GQ3S1.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccatgatatcccagccaggttcagtggcaggtgggtctgggacagagttcactctcaccatcagcacgcctgcagtctgaagtattttgctaatttattactgtacagcagtataataactgtctcctactacgtttgacctagggacctaagctaggatatacgaacgacgtagtgctgcactac

SEQ ID NO: 69577 - DNA, 567 bp, Homo sapiens
  misc_feature: GYAE6OF02JKFFQ.51.76.G10.1.454.CMB.1.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcagaacctggaccaggctcccgagctcctanatctatgactgccatccacgaagggcctacgtgactactcccgagccgaggttcaggtcggctaggtggtctagggacagtagttaccactcgcacagtcacgcacgctnctacgtctagtagtagtttgacttaatttacgttatacgttctagcctaagtacttaacgtaacgttccgtaccttccgtaacttacgtttacggaccgttacgggacctaacggtcgttaaggacgtacgtacgtaaacggtacgtcgtaggtactacggctaaccgtcg

SEQ ID NO: 69578 - DNA, 548 bp, Homo sapiens
  misc_feature: GYAE6OF02FZF3N.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtagcagcgacttagcctggtaccagcagaaacctggccaggctcccaggctccctcatctatgatgcactccaacgaagggccacgtgatactccagccaggttcagtggcaggtgggtctgggacagagttcactctcaccatcagcagcctgctagtctaggaagttattttgacttaaattttacttacttgtcagtactaaggttaattaaagtaacgttcggtccttaccgtacgttaccgttttcggccgaggggtaacctaggtcgtaggtagactaacgaaacgtactggtacggtctacgacctaccgtacg

SEQ ID NO: 69579 - DNA, 521 bp, Homo sapiens
  misc_feature: GYAE6OF02GMUR1.51.76.G10.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
  modified_base (406)..(406): a, c, t, g, unknown or other
  misc_feature (406)..(406): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatnatgcatccanaagggccactgactatcccagccaggttcagtggcagtggctgggacngtagttcactctcaccatcagcagcctgcagtctgagtatttgactatttattactntcagtcagtataataactgtaccctacgtactacgtttcgaccgtaggggaccaaggtcgtaggtacggtacttacgaaaccgtacgtaggtacggtactaggaccgtacctacg

SEQ ID NO: 69580 - DNA, 712 bp, Homo sapiens
  misc_feature: GYAE6OF02HRZST.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccacctgtctgtgtctaccgaggggaaagacgccaccctctcctgcgagggccagtcagagtgttagcagcgacttagctggtaccagcaagaaccgtggacacggctccgaggcctacgtcactactagtcgatgctactaccgaagtaaacgggccaacgtacgtactaccgtacccgagtaccgacggtttaccgagggtcgtcgtagggttcgggtcgtacgggacgtagtacgtttaccgacttaccgtcgaaccgtacgttaacgacgtaccgtacggtacccgtacgtacgtaacggttccggtaaggtaaacgtttacgtttacggttaaacttaattttaacgttacgtttacgtaaccgtagtacgtaaagttaaacgttaaacttaccggttacgttacccgttacccgtttaacgtaaccggtttttacgggacccggttaacggggaccgttaacgggtccgtaggaacgtaaccgttaacgaaacggttaacgttacgggttacgtaccggtacggtaccgtacctaaccg

SEQ ID NO: 69581 - DNA, 511 bp, Homo sapiens
  misc_feature: GYAE6OF02F3J23.51.76.G10.1.454.CMB.1.raw
  modified_base (196)..(196): a, c, t, g, unknown or other
  misc_feature (196)..(196): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccaccctctcctgcagggccagtcagagtgttagcagcgacttagcctggtaccagcagaaacctggccaggctcccaggctcctcatctatgatgcatccacaagggccactgatactcccagccagttcagtgcagtggtctgggacagagttcactctcaccatcagcagcctgcagtctagaagtatttgactaatttattactntcanctagtataataactcggtaccttccgtacttcgtttcggaccgtacggggaccaaggcgtaggagtaactacgaaacgtactggtggctcgacacctacg

SEQ ID NO: 69582 - DNA, 653 bp, Homo sapiens
  misc_feature: GYAE6OF02IPTIR.51.76.G10.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtntctcgaggggaaancgcccaccctctcctgcagggccagtcagagtgttagcagcacttgcctagtaccagcaagaacctggaccaggcctcccgaggcctcctacacttctagtgactgcctactaccaacggaacgggccctaacgtgtaacttaccgtaccccgagacccgttaggtttaccgaaggttcgggacgtaagggtttcggggtacgtaacggggtacaaggttacttaccgacgttctaccgaacctacgtacgacgcgacgcctaggactagtacgtagtaagttaacgttttcgtacttaattttacttacgtagtctaagtactaagttaactaaacgttacgtcgtaccttaccgttaacgttacgtttacggaccgtacgggtaacctaggtacgtacggtaacgtaacgtaaccgtaaaggacgttagggtcgtacgtacgtacctaccttacg

SEQ ID NO: 69583 - DNA, 640 bp, Homo sapiens
  misc_feature: GYAE6OF02HNCGC.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtcctgtgtctccgaggggaaancgcccaccctctcctgcgagggccagtcagagtgttagcagcgattagcctaggtaccagcaagaaacctggaccaggcctccgaggcctcctcatctatgtatgacactaccacgaacgggcccaacgtagaactacctacccgaacggtccgtaggtttccgaggtcggccgtagggttcgggtcgaggggactaggtacgttacctactctaccgtacctacgtactacgaccgtacgccgtacgcgtacgttacgtacgtaagtttagtttacgtacttaaagttttacttacgttacgtacgtaagtcgtaacgtttaactaacgttaaccgtaccgttaccttaccgttataccgtttcgaccggtacggaccgtaggtacgtaggaagtacgtacgtaaacgtacgtacgtacggtccgtagaccgtacctacg

SEQ ID NO: 69584 - DNA, 644 bp, Homo sapiens
  misc_feature: GYAE6OF02H9LFQ.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaagacgcccaccctctcctgcagggccagtcagagtgttagcagcgacttagcctggtaccagcaagaacctggaccaggcctcccgaggcctcctcatctatgatgcactccacgacggccagtgaatactcccagccgtaggttcaggtcggctagggttcgggtcgtaggggactagtacgtttccacttccgtaccgacctatacgacgccacggtcccttagacgtacggttctaacggtaagtttacgttttcgaaccttttaagttttacttaccgtgtacgagttaacgtaagttaataaacgttaccgtcgggtacccttacgtacgtttacgtttacggacccggtaacggggtacctaggtcggttaagggaacgtaaccgttaaccggaaacggttacgttagggtaccggtacccgtacggtaccccacgttaccgg

SEQ ID NO: 69585 - DNA, 563 bp, Homo sapiens
  misc_feature: GYAE6OF02ID9CR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcaagaacctggccaggcctcccaggctcctcatctatgatgcatccacaacgggccactgactactcccagcctaggttcagtggctaggtgggtacgtgggacaggtagttccacttctaccacctatccagccagccctgcagtctgtaagtattttgacttaattttacttactgtacagtactaagtataaacgtacgtcggtaccttccgtacttacgtttcggaccgtagggtaccctaaggccgttaggacgtaactaccgtaaacgacgttaggttaccggactacggaccctacgtacg

SEQ ID NO: 69586 - DNA, 598 bp, Homo sapiens
  misc_feature: GYAE6OF02IR53C.51.76.G10.1.454.CMB.1.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagcccacctctcctgcagggccagtcagngtgttagcagcgacttgcctggtatcagcagaacctggccaggctacccgaggcctcctcatctagtgatgcatccaacgaacgggccacgtgactactcccagcctaggttcagtgcaggttggtcgtagggactaggtacgttccacttctaccactatcacgcacgcctgactagtctagtaagttactttcgacttaatttacgttacttcgtacgtacgtacgtaaagtaattaaacgttaccgtcggttacccgtacccgttaacgttaccgttttccggaccggtaacggggtaccgtaaggtccggtaagggtactaacggtaaccgtaaacggtacgttcggtaccggtactacggccctaacg

SEQ ID NO: 69587 - DNA, 711 bp, Homo sapiens
  misc_feature: GYAE6OF02JG050.51.76.G10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (288)..(288): a, c, t, g, unknown or other
  misc_feature (288)..(288): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccaccctgtctgtgtctccaggggaaangcccaccctntcctgcagggccagtcagagtcgttagcaagcgacttagccgtggtaccagcagaaacctggaccaggctcccaggctccnatctatgactgctactaccaacgaacgggtcccaaagtgtaacttacctaccccgaaggtacccctagggtttccaaaggtttcggggaccctaaggggtttgggtcccgtagggggaacctaggtacggttccctaacttccgttaccaacccgtaattccgaaaggtcccgacgtacccgttaggtaccaacggtttacgtacggtaaacggtttacgttttacgggtacccttaaagttttttaacgttaccgttacgtaacccgtaaggtaccttaagggtaaacttaaacgtttaaaccgttccggtaccctttaacccgttacttaacccggttttagggaccccgtagggtaacccgagtccggtagacgtaacgtacgaaacgtacgtcggtacgacgtacgtacctacgtaacg

SEQ ID NO: 69588 - DNA, 550 bp, Homo sapiens
  misc_feature: GYAE6OF02HT7IT.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagagtgttagcagcgacttagcctggtaccagcaagaaacctggccaggcctcccaggctcctcatctatgatgcatccacgacggccactgatactcccagcctaggttcagtcggcaggttcgggtctggggacaggtacgttcacttctaccacctatcacgacacgtcctgctacgtctagtaagtatttgacttaatttattactgtactagtctagttataacgtactcgtccttaccgtactacgtttcgaccgtacgggacctaggtcgtacggacgtaacgtacgaacgtacgtcgtacggcgtacgacctacctacg

SEQ ID NO: 69589 - DNA, 577 bp, Homo sapiens
  misc_feature: GYAE6OF02HRM9F.51.76.G10.1.454.CMB.1.raw
  modified_base (197)..(197): a, c, t, g, unknown or other
  misc_feature (197)..(197): n is a, c, g, or t
  modified_base (286)..(286): a, c, t, g, unknown or other
  misc_feature (286)..(286): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaanagccaccctctcctgcagggccagtcagagtgtagcagcgacttagcctggtaccagcaagaaacctggaccaggctcccgaggctccncatctatgatgcatccagaggccatgatactccagccaggttcagtggcaggtgggtctggggacaggtacgttcacgtctaccacactacacgctacgcctgctagttctagtaagttagtttgtacttaagtttacttacgttgtactagtactaagttaacttaagtaaccgttacggtaccttaccggttaacgttacgttttcgggacccgtacggggtaacctaacggtcggtaggagtaacgtaccgaaacgtacgtacggacggtacgtacgtctaacctacg

SEQ ID NO: 69590 - DNA, 558 bp, Homo sapiens
  misc_feature: GYAE6OF02I9R1I.51.76.G10.1.454.CMB.1.raw
  modified_base (196)..(196): a, c, t, g, unknown or other
  misc_feature (196)..(196): n is a, c, g, or t
  modified_base (281)..(281): a, c, t, g, unknown or other
  misc_feature (281)..(281): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaacctggccaggctccagcctcnatcatgatgcatccaacgaagggccactgactactcccagcctaggttcaggtgcaggtggtctgggacngagtcactcncacatcagcagcgtncacgtctacgtaagtatttgacttaatttacttactgtcagtacgtaagtactaaattacgtacggaccttaccgtaccttaacgtttcgggacccgtaggggtacctaacgggtcgttaggaagtaactaaccgtaaacggaaccgtttagggtaccggtacgtacggaccaccgttaacg

SEQ ID NO: 69591 - DNA, 826 bp, Homo sapiens
  misc_feature: GYAE6OF02H8EVM.51.76.G10.1.454.CMB.1.raw
  modified_base (224)..(224): a, c, t, g, unknown or other
  misc_feature (224)..(224): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagacgccacctctcctgcgaggccagtcagngtgttagcagcgtattacgccttacggtaccaggctaacgaaacgtcggaccacggcctacccgaggcctaccgtacctacttaccttagtcgtacgtacgcctaaccgttaccccgaaaccggaaaccggggtccctaaccgttacggtaaacctttaaccgtacccccgaacggtacccgtaaccgggtttaccgtaaacggggttccgggaccggttacgggttcgggggttaccgttaacgggggaaccgtaaacgggttaacggttttccccaacggtttacccgtaacccgtacccgtaaacgttaccccgaaacggtacccgtaaccggtccccgttacggtaaccgtaacgttcccggttaaggttaaaacggtttctttttaacggaaccttttaatttttaccgtttaacgttcgttacgaagtttaccgtaagttaaactttaaaccgtacgtaccgtttaaccgtttccccgttaaagtttaccggttttacggaacccgggtacggtaaccgtacggtaacggttaggaggtaacccttaaccggtaaacgttacggtaggtccggtaccctaggtacctacccgttag

SEQ ID NO: 69592 - DNA, 548 bp, Homo sapiens
  misc_feature: GYAE6OF02HYI3A.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggccaggctcccaggctcctcatctatcgatcgcactccaacgaacgggcccaacgtgactacgtccccagccgtaggttcaggtggcaggttgggtctgggacaggtagttcactctaccaccatcagcacgcctgctacgtctagaagttatttagtacttaatttattactgtcagactagtataataacgtcgtccttaccgtactacgtttcggaccgtagggaccaggcgtaggagtacgtacgaacgtacgtggtacgtacgtacgaccgactacg

SEQ ID NO: 69593 - DNA, 519 bp, Homo sapiens
  misc_feature: GYAE6OF02FMO9I.51.76.G10.1.454.CMB.1.raw
  modified_base (196)..(196): a, c, t, g, unknown or other
  misc_feature (196)..(196): n is a, c, g, or t
  modified_base (390)..(390): a, c, t, g, unknown or other
  misc_feature (390)..(390): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttcagtggcaggtgggtctgggacagagttcactctcaccatcagcagcctgcagtctgaagtnttttgctaatttattactgtcagctatataataactggtcctccgtactactttcggaccgtacggggaccaacggtcgtaggaagtaactacgaaacgtacgtggtacggtacgtcggtacacctacg

SEQ ID NO: 69594 - DNA, 576 bp, Homo sapiens
  misc_feature: GYAE6OF02HRGXR.51.76.G10.1.454.CMB.1.raw
  modified_base (197)..(197): a, c, t, g, unknown or other
  misc_feature (197)..(197): n is a, c, g, or t
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcaagaacctggccaggcctccgaggctctcatctatgatgcatccagaacggccatgatacnccagcctaggttcagtgcaggtggtctgggacaggtacgttcacgtctacgactatacagcgtacgcctgctagtctaggtaagttatttcgtacttaattttacgttaacttgtactagtactaagttaactaacgttacgtacgtaccttaccgtacgttacgttttacggaccgtacgggtacctaaggtcgtaggtacgtaacgtaaccgtaaacggtacgttacggtacggtaccgtacgtacccgtacgttacg

SEQ ID NO: 69595 - DNA, 781 bp, Homo sapiens
  misc_feature: GYAE6OF02IS50L.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctccgtgcgacgggccagtcagagtgttagcagcgacttgcctggtaccagcgaagaaacctggccaggcctaccccgaggccttccctctacttcctagtcggtatcggactaactccccgaacgaacggggccctacgttagaactacctaccccgacggtcccgtaacgggtttccgagggtcggacgtaggggtttcggggtccgttaggggacctaagggtacgtttaccaccgttccgtaccaacccgtacgttaccgaacggacccgtacggaccccgttggaccgtaacggttccgtaaggttaaacgtttacgtttttaaggtaacctttaaacgtttttaaacgtttaaccgttaggttacctaggtaccgtttaaaggttaaactttaaacgttaaccggttaccggttaaccccgtttacccgtttaacctttaaccgggttttcgggaacccgggttaacggggaacccgtaagggtaccggttaacgggtaagtaccgttaaaccggtaaaccgtaacggttcgggttaccggacgtttaccggaccttaacccgttacg

SEQ ID NO: 69596 - DNA, 582 bp, Homo sapiens
  misc_feature: GYAE6OF02FZ8OS.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaacgggccactgactactcccagccaggttcaggtggcaggtgggtctgggacagtagttcactctcaccatcagcacgcctcgcacgtctagaagttattttcgacttaaatttatttaactgttacgagtctaagttaacttaaataaccgttcggtacccgttaccgttaactaccgttttacggacccggtaacggggaacccgtaacggtccgtagggtaacggtaacgtaccgaaacggtaaccgtcggtacggtcgtacgtacctaccgtaacg

SEQ ID NO: 69597 - DNA, 601 bp, Homo sapiens
  misc_feature: GYAE6OF02HCUAJ.51.76.G10.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctccagcccaccctgtctgtgtctccgaggggaaangccaccctctcctgcagggccagtcagagtgttagcagcgattagcctggtaccagcagaaacctggaccaggcctcccgaggctccnatctatgatgcactccaacgaagggccacgtgatactcccgagccctaggttccaggttcggactagggttcgggtacgtggggaacaggtagtttccacgttcctaccaaccactcacgcacgcccgtgacgtacgtctagtaagttatttgtacttaatttacttactgtactagactagttataacgtaacgtcgttaccttaccgtacttaccgttttcggaccgtacggggtacctaacggtcggtaaggtacgtaacgtaaccgtaaaccgtacgttacggtacggtaccgtacgtaccaccgtaacg

SEQ ID NO: 69598 - DNA, 569 bp, Homo sapiens
  misc_feature: GYAE6OF02H9RG0.51.76.G10.1.454.CMB.1.raw
  modified_base (197)..(197): a, c, t, g, unknown or other
  misc_feature (197)..(197): n is a, c, g, or t
  modified_base (317)..(317): a, c, t, g, unknown or other
  misc_feature (317)..(317): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcgagggccagtcagagtgttagcagcgacttagcctggtaccagcagaaacctggccaggcctcccgaggctcctcatcctatgatgcatccacgaagggccangatactcccagccaggttcagtggcaggtggtctagggcagtgttccatctacgaccatcagccagcctgctgtctagtaagttattttgacttaattttacttacgtgtcagtactaagttaataattaacgtcggtacccttaccgttacttaccgtttcggacccgtacggggacctaaggtcttaacgggaataacgttaaccgaaaacgtcggttacggtacggtccgtacgtaccctaaccgtacg

SEQ ID NO: 69599 - DNA, 779 bp, Homo sapiens
  misc_feature: GYAE6OF02FGZ14.51.76.G10.1.454.CMB.1.raw
  modified_base (185)..(185): a, c, t, g, unknown or other
  misc_feature (185)..(185): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (568)..(568): a, c, t, g, unknown or other
  misc_feature (568)..(568): n is a, c, g, or t
  modified_base (764)..(764): a, c, t, g, unknown or other
  misc_feature (764)..(764): n is a, c, g, or t
tcagcgatcgtatacacgaccggtgctcgatttagtcactcatacaggggagaactgctcagttaggacccagacggaaccatggaacgccccagcgcagcttctccttcctcctgcttacctctcggcctacccagtactaccgacgtgggaagtaagtagttggaactcggaccgcacgtccncccacgcccaccctgtcctgtcgtccgtaccggaagggggaaacnccgccctaccctcgtaccnggacgaccgggacctagtcgaggtacggtacgttcgccgtacggtcgtaaccgtttacggcccgtacggtaacccagaccaacggtaaacccggtcggacccgttaccgggacccctacccgacggtccccttaccgtcctaacgtactacgtagaacgtcgtacctaaccctacggaacggtaaccgggtacctacggttctaaccgtacccgttaccgacggttaccggttacgggtttacgaccggggtagacggggttacgggtcggttaacgggacggttaacgtacggttaacccttccacccgttcgaaccncctaacggttccacgtacgtaccgtcgtatacgtacgtataacggtatttacgttactactttagtacccgttgtactacgtaacgtactaaggtaactttaccgtaccggttacgtacccgttaccttacggtagtccggaaccgtacgacgacgttacggacgtaaacgtacgaacgacgtagcggtaccgttnacccgtatccgtacg

SEQ ID NO: 69600 - DNA, 701 bp, Homo sapiens
  misc_feature: GYAE6OF02FZ9KB.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcagaaacctggccaggcctcccaggctcctcatctatgatgcatccacgaacggccactgactactcccagacccgtaggttcaggtggcgtagggtcgggtcgtaggggaactaggtacgtttccaacgttcctaccaacctactaccgaacggtcaccggtccctggacctacggttacgtaaggtaaacgtttacgttttacggaactttaagtttttaaccgttacgttacgttaccgtagtaccgttaagttaacttaaaacgttaacccggttaccgggttacccctttaacccggttaccgtttaaccggtttttacggggaacccgtaacggggtaaccctaaccggggtaaccgttaaggggtaacgttaaacggttaaaaccggtacgtttacgggtacggtaccgttacggaccccgtacgtaccgtttaccgg

SEQ ID NO: 69601 - DNA, 658 bp, Homo sapiens
  misc_feature: GYAE6OF02JZ927.51.76.G10.1.454.CMB.1.raw
  modified_base (197)..(197): a, c, t, g, unknown or other
  misc_feature (197)..(197): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctccagccaccctgtctgtgtctccgaaggggaaancgcccaccctctcctgcagggcctagtcagatgtagcagcgattagcctggtaccagcgaacgaaccgttggaccaggcctaccccgaggtcccttccgactagtccctataggactgacctgtacccacgaaacgggcccaatcggtaactacctacccaggttcctaaagggtttccaaggttcgggacctaggggttcgggttacncggggaacngggtacttccacgtctacgaccctanacacggactacggctacgactacgttcagttaacgttatttacgaccttagtttactttagtccggtatagttactagttaaataccgtaagttcccggtacttacccgttaacttaccggttacgtacccgacgggtaaccttaagccggttaaggaccgtaactaaccggtaaacgttaacggcgttacggactaccggttacaacctttaccgg

SEQ ID NO: 69602 - DNA, 552 bp, Homo sapiens
  misc_feature: GYAE6OF02H0FNI.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccacctcgtcctgcagggccagtcagagtgtagcagcgacttagcctggtaccagcagaacctggccaggctcccaggcctctcatcgtatgatgcatccacaagggccagtgatactccagccagttcagtgctaggtggtctaggggacaggagtttcgactcgtcaccatacagcagcctgacagtctgtaagtatttagactaagttttattactgtctagactagtaactaacgttaactcgtaccgttaccgtacgttaaccgttttcggaccggtacgggaccgtaaggtcgtacggtacgtaacgtacgaaaccgtacgtaggtacgacgtcgacctacgtaacg

SEQ ID NO: 69603 - DNA, 753 bp, Homo sapiens
  misc_feature: GYAE6OF02IL91E.51.76.G10.1.454.CMB.1.raw
  modified_base (146)..(146): a, c, t, g, unknown or other
  misc_feature (146)..(146): n is a, c, g, or t
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagtcttctcttcctcctgctactctcggctcccagataccactgganaagtagtgatgacgcagtctcagccacctgtctgtgtcctccgaagggaaacncgccaccctctccgtgccgagggccagtcaggacgttggttacgacgtagtccgtagttaccggcgttacgggtaaccacggtacaaacgggtaaacctgggacccgaacgggtcctacccggaacgggtccttccctacgaactttctaacgttcggaacttcgaccaccgtaacccgaacggaaccgggtaccctactaaggtacctaaccccttacccgacggtacgtaacgggtttccagggttaccggcgtacgggtttcgggtaccgagggtacctaaggtttacttacccgacgttccgtaccgtaacctacgtacgaaccggaccgtaactcggtaccgtaccgttacggttaccgttaggtaaacgtttaacgttacgtttaaccgttaagttttaaccgttactacggtcttacgtaacttaacgttaataacgttacgtaccgttacccttacgttacctaccgttagtacccggacggttacgacggttcggaggacttaacgacgtaaacgtacgttcggacgtacgtactcacgttaacg

SEQ ID NO: 69604 - DNA, 759 bp, Homo sapiens
  misc_feature: GYAE6OF02HFHAL.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgttagcagcgacttagcctggtaccagcaagaaacctggccaggcctcccgaggcctcctcatctatgatgcactcccaacgaacgggcccaacgtacgacttaaccgtaccccgaacgtcccgtaagggtttccgaaggttcgggtaccgtaggggtttcggggtacgtacgggggaaccgtaacgggtacggtttacctaacccgttccttaacccaacccgtacgtacctaacggacccgtaacggtcccgttaggacctaacggttcgtaaggttaacgtttacgtttttacgtactttaaatttttaacgtttacgttagtaccgtaggtaactaaacggtttaaacttaaacgttaaccggttaccggttaccccgtttaccggtttaaaccgtttaccgttttaccgggacccggtaaccggggtaacccgtaacggtacggttacgggtaaacgttaaccgtaaccggtaaaacggtacgggtttacggtaccgggttacgtccggtaccgtaccgttaaccg

SEQ ID NO: 69605 - DNA, 560 bp, Homo sapiens
  misc_feature: GYAE6OF02IE3B3.51.76.G10.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (416)..(416): a, c, t, g, unknown or other
  misc_feature (416)..(416): n is a, c, g, or t
  modified_base (523)..(523): a, c, t, g, unknown or other
  misc_feature (523)..(523): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggaagaagtagtgatgacgcagtctccagcccaccctgtctgtgtctccgaggggaaancgccacctctcctgcagggccagtcagagtgttancagcgtattacgccttaggtaccagcaagaaacctggccaggctacccaggctctcatctatgatgacataccagaacggccaacgtgaactacctacccaaggccgtaaggtttcaggtggacgtagggtcgggttacgtaggggacaaggtagttcaccgtctcacatcacgcaagtccngcagttctagaattatttagactaattttatactgtacagtactagttaataaatacgtcgtacctacgtacttcgtttacggccgtacgggactaggcgtaggtanacttaacgaaacgtctggtacgctacggcctaagtcg

SEQ ID NO: 69606 - DNA, 617 bp, Homo sapiens
  misc_feature: GYAE6OF02I7Y2F.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgtagcagcgacttagcctggtaccagcaagaacctggaccaggcctcccgaggcctcctcatctatgatcgcactccaacgaacgggccagtgaactacctccagcctaggttacaggtcggcagggttcgggtcgtaggggacaggtacgttccaacgtctaccgaccgtactacgacgtacgacgtcctaggactagtacgtagtaaacgttactttcgtacttaattttacttacgtcgttacgacgtactaagttaactaaacgttaacgttacggtaccttaccgttaacgttacgtttcggacccggtacgggtacctaacggtcgtacggtaagtactaccgaaacgtacgtcggtacggtcgtacgtaccgtaccgtacg

SEQ ID NO: 69607 - DNA, 544 bp, Homo sapiens
  misc_feature: GYAE6OF02H4N7Z.51.76.G10.1.454.CMB.1.raw
  modified_base (196)..(196): a, c, t, g, unknown or other
  misc_feature (196)..(196): n is a, c, g, or t
  modified_base (396)..(396): a, c, t, g, unknown or other
  misc_feature (396)..(396): n is a, c, g, or t
tcagcgatcgtatacacgaccggtgctcgatttagtcactcatacagggggaggaactgctcagttaggacccagagggaaccatggaagccccagctcagcttctcttcctcctgctactctggctcccagatgccaccggacaaattgtgttgacacagtctccagtcaccctgtctttgtctccaggggaaangccaccctctcctgcagggccattcagagtattaacagcgacttagcctggtaccagcagaaacctggaccaggcctccgaggctcctcatctatggtgcatccaccagggccactcggcactcccagccaggttcagtgcagtgggtctgggacaggtacttcgctctacaccatcagcagcctagcgtcctagaagtntttcgactagtttattattgtcagcagacaaactactcgccttcgtcggacgttcggcgaacgggaccgaaggtagaaactacgaaacgacgtaggtcggtactagaccaaccgattccgttacgttcctttctacttcccgtacccg

SEQ ID NO: 69608 - DNA, 538 bp, Homo sapiens
  misc_feature: GYAE6OF02GWFRZ.51.76.G10.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctntcctgcagggccagtcagagtgttagcagcgtacttagcctggtaccagcagaaacctggccaggctcccaggcctcctcatctatgatgcactccaacgagggccactgatactcccagcctaggttcaggtcggctaggtgggtcgtgggacagtacgttcactctcaccatacacgcacgcctgcagtctagtaagttatttgacttaagtttcttactgtcagtactaagttataagtactcgtcccttacgtacttacgtttcggaccgtacgggaccaggtcgtaggacgtactacgaacgtacgtggtacgctacggcctactcg

SEQ ID NO: 69609 - DNA, 672 bp, Homo sapiens
  misc_feature: GYAE6OF02IPO2C.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcaagaaacctggaccaggcctacccaggcctcctcatcgtatgatcgacctatccaacgaacgggcctaacgtcgaactacgtcccagcctaaggtcgagtcggctaggtcggtcgtgggacagtacgttccacgtctacaccactacgacgcgacgtccgtacgtcgtacgtacgtaggtaagttacgttttacgtactttaaacgttttaacgtttaacgttacgtacgtaagtaccgtaagtttaaactaaacgtttaaaccgtacgttacccgttaacccgttaacgttaccgttttaaccgggaccgtaacgggggttaaccaacggttacggtaacggtaacgtaaccgttaaaccgtaaaacggttaaccgttacggtcggtaaccgtacgtacccgtaaccgttaacg

SEQ ID NO: 69610 - DNA, 691 bp, Homo sapiens
  misc_feature: GYAE6OF02G5C9P.51.76.G10.1.454.CMB.1.raw
  modified_base (324)..(324): a, c, t, g, unknown or other
  misc_feature (324)..(324): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcaggcgacttagcctggtaccagcagaacctggccaggcctcccgaggcctcctcatctatgatgcatccaagaacgggccactgactacncccagccctaggttcaggtggcagggtcggtcgtaggggactagtacgttccactcctcaccatccacgctacgccgtgcctacgtcgttagtaacgttagttttacggacctttaaagttttacttacgtttcggttacctaagtaccttaagttaacgtaaacgttaaaccgtttccgggaccccttttaacccggttacccttttaaccgggttttttaccggggacccggttaaccggggggtaacccctaacggggtaccggtttacgggtaaacggtaaccgttaaccggtaaaaccggttaacccggtttagggtaaccgggttaccggtttacccgggacccgttaacccgttaaccgg

SEQ ID NO: 69611 - DNA, 704 bp, Homo sapiens
  misc_feature: GYAE6OF02IODKW.51.76.G10.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (503)..(503): a, c, t, g, unknown or other
  misc_feature (503)..(503): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcgagggccaggtcagagtgtagcagcgacttagcctaggtaccagcaagaacctggccaggctcccgagcctcctctatctntcgatcgcactccaacgacgggtaccacgttacgatactacccgacgtacgtacggttccgaaggtcggtaccgtaagggtcgggttaccggacgggggaaccttaaggtaaccgtttaccgtacccgttaccgtacccgtaaccgttacgacgtaaccgaccggtaaccggtcccttaaggccgtaacgttccgtaacgtaaaggtttntttacggaactttaaacgtttagttaccgttcgtaactaggtaacccttaaggttaaactaaaacgttaacccgtacgggttacccttaccgttaaacttccggttttacgggaaccgtacggggaaccttaaggtccgaggtaacgtaactaaccggtaaacgtacggttcgtaccggacgtacggtaccaaccgttacg

SEQ ID NO: 69612 - DNA, 769 bp, Homo sapiens
  misc_feature: GYAE6OF02JFE9J.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccagtggaacgccccagccgcagcttctcttcctcctgctactctggcctcccagataccactggaagaagtagtgatgacgcagtctccagccaccctgtctgtgtctccgaggggaanacgcccaccctctcctgcacgggcctagtcagagttgttacgcgagccgacttagcccgttggtacccagccgaagtaaacccgtggacccaggccctaccccgaggtccttccctctaacttccgtaagtgactcggtaccacgtaccccaacgtaaccggggcctaaccgttaggaccttaacccgtaccccgacggtaccccgtaaggtttcccgaaggtttgggacccgttagggtttcgggtacgttcggggaaactacgggttactttaccgaacccgttcctaccgaacccgtagttacccgtaaagggccctaacgtcccgtagtaccgtaacgttacccgtagggtaaactttggtttaccgttacgttaaactttttacgtacgttacgtaccgtaagtgttaaacggttactaaacgttacccgttcgggtaaccctttacccggtagtttaccgggtttaccgggccggaaccgggtacctaacggtcgttaaggaaccgttaaacgtaaccggtaacgaacgtttcgggacgtacgacgtacccgtaccttacgg

SEQ ID NO: 69613 - DNA, 551 bp, Homo sapiens
  misc_feature: GYAE6OF02IT641.51.76.G10.1.454.CMB.1.raw
  modified_base (197)..(197): a, c, t, g, unknown or other
  misc_feature (197)..(197): n is a, c, g, or t
  modified_base (321)..(321): a, c, t, g, unknown or other
  misc_feature (321)..(321): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagcagaaacctggccaggctcccaggcctcctcatctatgatgcatccacaacgggccactgatacncccagccaggttcaggtggctaggtgggtcgtagggacagtacgttcacgtctccacctatcagcacgcctgcagtctagtaagttactttagacttaatttattactgtctagtctagtaataataacgtcgtaccttaccgtacttacgtttcgggaccgtacggggacctaggtcgtaggaacgtagtaaccgaaacgtacgtggtacggacgtacgaccacctacg

SEQ ID NO: 69614 - DNA, 758 bp, Homo sapiens
  misc_feature: GYAE6OF02H1HBV.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagagcccaccctctcctgccagggccagtcagagtgttagcagcgtacttgcctggtaccagcaagaaccgtggaccaggcctacccgaggcctcctctatcctatgatgactactaccaacggaaccgggccaacgtagtactaccgtccgacgtccgtaacggttcaggttcggcgtagggttgggtaccgtagggaccaaggttaccgttactaccgttctaccaccgttaacgtcgaccgtaccgtacgtacccgtaggtcctaacggttacgtaagggttaagttaactttttacggtaactttaaacgttttttacgttacgtttaccgtagttaaccggtaacgtttaaacgtttaactttaaacggtaaccgttacccgggttacccgtttaaaccggtttaaacccgtttacgggttttacccgggaacccgggttaaccgggggtaacccgtttaacgggtcccggttaaagggtaaccgttaaccgttaaacccgggttaaacggtacggtttcgggaacgttaccggtaccggtaacccttacgttaccg

SEQ ID NO: 69615 - DNA, 528 bp, Homo sapiens
  misc_feature: GYAE6OF02G8T3E.51.76.G10.1.454.CMB.1.raw
  modified_base (285)..(285): a, c, t, g, unknown or other
  misc_feature (285)..(285): n is a, c, g, or t
  modified_base (393)..(393): a, c, t, g, unknown or other
  misc_feature (393)..(393): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggctcctnatctatgatgcatccacagggccactgatactcccagccaggttcagtggcaggtgggtctgggacagagttcacgtctcaccatcagcagcctgcagtctagaagtntttgacttaatttattacttgtctagctaagttataaagtacgtcgtccttccgtactactttcgggaccgtacgggtaccgaaggtcgtaggagtacgtacgaacgtaacgtggtggtacgtcgaccgactacg

SEQ ID NO: 69616 - DNA, 679 bp, Homo sapiens
  misc_feature: GYAE6OF02II5J6.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagcccaccctctcctgcagggccagtcagagtgttagcagcgtacttcgcctggtaccagcaagaaaccgtggccaggcctcccaggcctcctcatctatcgatcgctactcccgaacgaacgggcccaacgtgaacttaccgtccccaggacccgttaaggtttccaagggttcggacgtagggtcgggttcgaggggtaaccaaggtcggtttaccaccgttcttacccgaacctatccgaacgtcctaacggcccttgggacctagggtctagggtaaagttactttttcggtaacttaaggtttttaattaccgttaggtacctagtacgttaaagtttaactaaagtttaaccggtacgttaccctttaaccgttaaccggtttaccgtttacgggaccggtaacggggaccttaaggtcggtaggtacgtaacgtaacgaaaccgtagttcggtacgtcgtaccgtacaccgttacg

SEQ ID NO: 69617 - DNA, 707 bp, Homo sapiens
  misc_feature: GYAE6OF02JL0SK.51.76.G10.1.454.CMB.1.raw
  modified_base (107)..(107): a, c, t, g, unknown or other
  misc_feature (107)..(107): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
tcagcgatcgtatacacgaccggtgctcgatttagtcactcatacagggggagggaactgctcagttaggacccagacggaaccatggaagccccagcgcagcttcncttcctctgctactctggctcccagataccactggagagtagtgactgacgcagtctccagccaccctgtctgtgtctccgaggggaatcgccacctctcctgcagggccagtcagngtntacgcagcattgctgtacngcagaacctggaccaggcctccgagcctcctacatcctagcgactgactatcccaaggtaacggccacgtgaagtacctcccgaaggtcctaagggttccaagggttcgaccgtaagggtttccgggacgttaggggaaccttagggtacgtttacccgaactttcccgtcgaaaccgtacgttaccgacgtaccgtaacggtccccgtacgacgtaacgttccggtaagtaaccgttagttttacgtaccgtttaagttttaacgttaaccttggttaacctagtacgttaacgttaacttaaacgtaacgttcggtaacccttacggtttaaaccttccgtttaacgggacccggttacgggtaaccggttaccggtaacgttacgggtaaacgtaacctaaccggtaaacgtaccggtttacggaccggttacctaaccggtaccgtaacccgttacg

SEQ ID NO: 69618 - DNA, 616 bp, Homo sapiens
  misc_feature: GYAE6OF02GJLB7.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanacgccaccctctcctgcagggccagtcagagtgttagcagcgacttagcctggtaccagcaaggaacctggccaggcctcccgaggcctcctcatctatcgatcgcataccaacgaacgggccatgactactcccgagcccgtaggttcaggttcggacgtagggttcgggtacgtgggaactaggtacgttaccacttccgtacacctatacgacgcacgtcctgactacgtctagtaagttagttttacgacttaattttacttacgtagtacagactaagttaattaaagtaacgtcggtacccttacggttaaccttacgtttaccggaccggtacggggtaaccaacggtcggtacggtaacgtaacgttaaccgaaacggtacgttcggtacggctacggacctaaccgttacg

SEQ ID NO: 69619 - DNA, 688 bp, Homo sapiens
  misc_feature: GYAE6OF02JB5OG.51.76.G10.1.454.CMB.1.raw
  modified_base (442)..(442): a, c, t, g, unknown or other
  misc_feature (442)..(442): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagagtagtgatgacgcagtctccagccaccctgtctgtgtctccgaaggggaagagcccaccctctccgtgcgacgggccagtcgagagtgttagcagcgtacttagcctggtaccaacaacgaacctggccaggcctcccgaggcctcctcacgttcctatcgatcgcctactcccgaacgaaccgggcccagtcgtaactacctaccccgaacgtaccgtaggttcgagggtcggcgtagtggggtccgtggggacctaaggtacgttccacgtcctaccaccatcgacgcaagtccgngacctagtcgtagtaagttattttacgactttaaatttaacttcgttacgttacgacgtacgtaagttaacttaacgtaacgtcggttaacccgttacgtttaaccgttaacgttttacgacccgggttaacgggtaaccgtacgttaccgggttaaggtaaccggttaacgttaaccggtaaaaccgttacggttacgggttaccggggtacgttaccggtacccgttacccgtgtttaacccgg

SEQ ID NO: 69620 - DNA, 677 bp, Homo sapiens
  misc_feature: GYAE6OF02J1OV3.51.76.G10.1.454.CMB.1.raw
  modified_base (199)..(199): a, c, t, g, unknown or other
  misc_feature (199)..(199): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtcgtcctacgaggggaaancgcccacccgtntccngccgagggtcccaggtcagtagttcgttagcaggaccgtacgttagcccgttaggtaccagtcaacggaaaccgtggacccgaaggtcctacccgaggcctccgtctacgtacgtatacgactgacctaccgtaccgaaccggaacgggccagtacgactactcccgagtccctaggttaccaggtcgacgtggttcgggttacggtacggacgtacgtacgttacaccgtacgtcacctctacgacgacgtaccgccgtcgtacgtacgtacgtaagtaagttacgtttactaacgttaatttaacttacgtagtacgtacgacgtaagttaactaaacgtaaccgtcgttacccgttacgttaccgtagtttaccgaccggtacgtaacgtaacggtggttacggacgtaaccgtaactaaacggtcgtttacggtcgtacggtacgacctacgttaccg

SEQ ID NO: 69621 - DNA, 764 bp, Homo sapiens
  misc_feature: GYAE6OF02HVKSM.51.76.G10.1.454.CMB.1.raw
  modified_base (144)..(144): a, c, t, g, unknown or other
  misc_feature (144)..(144): n is a, c, g, or t
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgganaagtagtgatgacgcagtctcagccaccctgtctgtgtctacgaaggggaaanacgcccaccctctcctgccgagggcagtcagagttgtacgngagcgacttacgcctaggtaccagcaacgaacctggaccaggtcctccccgaggccttccacgtatcctatcgatcgactactccaaacgaacgggccctaagtcgaaacttaccgtaccaacggtccgtaacggttccgtaaggtcggaccgtaagggtcgggttacgtaaggggaactaaggttacgtttaccaaccgttcctacgtaacctacgtacgacggtacgaaccgtaccgttacgtacgtacgttaccgttaggtaacgtttaaggttttacgttaacgtttaaacttttacgttttaacgttacgtacgtaacgtaacttaacgttaaacgttaaacgttaaccgttaccgttaacccctttaaccggttaaaccgtttaaccgttttaccgggacccggtaacggggtaacccgaacggttaacgggttaacggaacggttaaaccgtaaccggttaaaccggtaaccgttacgggtaaccgtaccggtaaccggttacccgtaaccgttaaccg

SEQ ID NO: 69622 - DNA, 776 bp, Homo sapiens
  misc_feature: GYAE6OF02JUBLV.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggagggaactgctcagttaggaccagacggaaccatggaagccccagcgcagcttctcttcctctgctactctggctcccagataccactggagaagtagtgatgacgcagtctccagccaccctgtctgtcgtctccgaggggaacnggcccaccccttcctcctaggccgacgggcccaggtccaggtagttaggttacgcaggtaccggtacttacggacccgttggtaacccaaggccgtaaacggtaaacccgtgggacccgaccgggtcctaccccgagggtccctacccgtactacgtacttagcggactgtaccacgtaccgacggaacggtccacgtagactaccgtacccacggtacccgttagttacccgaggttaccggggaccttagggggtttacggtccgggtaagggtaaccctaacgggggttcctacccgtacccgttttcgaacccgtaacccgtactacgtaaccggaccgtacgtcccggacgtacgtaccggttagtacggtaacgtttcgtttacgtactttaagtttcgttactacgtatacgttagtaaccgtaagttaaaccgttacgtacgttaccccgttaaccgttacgtttaacccgtttgggaacccgtaggggtaccctaggtccggttaacggtaacgtaaccgtaacgtaaaccgttacgtacggtccggttagtacccgtacaccgttaccg

SEQ ID NO: 69623 - DNA, 625 bp, Homo sapiens
  misc_feature: GYAE6OF02F83JV.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggcctcctcatctatgatgcatccacgaacgggccaatgactactcccagcctaggtcaggtggctagggtcgggtacgtgggacaggtagttccacgtcctcaccactcacgtcagtcctgacacgttacgtaggtaagttatttttaggactttaagttttacgttacttcggttaccaaggttactaacgtttaataaacttaacgtacggttacccttaccggttacctttaccggttttacggacccggtacggggtaccctaagggtccgtaagggtaacgtaacgttaaccgaaaccggttaacggttcggttacggtaccgtacggtacccacgttaaccg

SEQ ID NO: 69624 - DNA, 603 bp, Homo sapiens
  misc_feature: GYAE6OF02GILOT.51.76.G10.1.454.CMB.1.raw
  modified_base (196)..(196): a, c, t, g, unknown or other
  misc_feature (196)..(196): n is a, c, g, or t
  modified_base (309)..(309): a, c, t, g, unknown or other
  misc_feature (309)..(309): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagatgttagcagcgacttagcctggtaccagcagaacctggccaggctcccgaggctcctcatctatgatgcatccagacggccatnactactccagcaggttcaggtcggactaggtcgggtctaggggactaggtacgttccacttccacaccgacttacgacgcgacgtcctggactaggttcctaaggtaagttaacttttggacctttaagtttttacgtaacgttgttacgtaacgtactaaggtttaacttaaagttaccgtacgggttacccttaccgtaacgtttacggtttcggacccgtacggggaaccctaggtcgtaggaactaacgtaccgaaacgttacctcggtacgtcgtcgtaccgacttacg

SEQ ID NO: 69625 - DNA, 972 bp, Homo sapiens
  misc_feature: GYAE6OF02ISZOL.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggcctcccagataccactggagaagtagtgatgacgcagtcctcagccaccctgtctgtcgtctccgaaggggaagcgcccaccctctccctgcgacgggccagtcagtagttgttacgcacgcgtacttacgccgtaggttaaccaggacaacggaaacccgtcgggccccgaagggcccttaccccgaggccttcccgtactattccgtatacggtattcggacctacgtaaccgtaaccggaaccgggtccctaaccgttaggtaaacttacccgttacccgaacggttacccggttaagggtttacccgtaagggttccgggtaaccggtacggggtttacgggggttaccggtttacgggggaaccttaacggggttaaccggttttacccgaaccgtttacccggttaacccgtaacccggtttaacgtaacccggtaaccgggttaacccggttaaacccggttccccggttaacggtaccccgttacgggtttaacccggttaaacgggttaaagggttttaccgttttttacggtaaaccgtttttaagtttttaaacccggtttaccgtttacggttaacccgttaaaggtacccgttaaaaggtttttaaactaaaccggtttaacccggttacgggtttaacccccttttaaccgggtaaacccgtttttaacccgggttttaccggggtaacccggttaacccgggggttaaaccgtaaccgggttaacggttaccggggtaaaccgttaacccggttaaacccggtaaaacggggttacccggtttaccggggtttaaggccccggtttaaccgtacccgttacccgttaaccggg

SEQ ID NO: 69626 - DNA, 508 bp, Homo sapiens
  misc_feature: GYAE6OF02GFB6Y.51.76.G10.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
  modified_base (299)..(299): a, c, t, g, unknown or other
  misc_feature (299)..(299): n is a, c, g, or t
  modified_base (394)..(394): a, c, t, g, unknown or other
  misc_feature (394)..(394): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
  modified_base (476)..(476): a, c, t, g, unknown or other
  misc_feature (476)..(476): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagngtgttagcagcgacttagcctggtaccagcagaaacctggccaggctcccaggctcctcatctatgatgcatccanaacgggccactgatactcccagccaggtcagtggcaggtgggtctgggacaggagttcactcctacaccatcagcagcctcgcagtctagaagtntttagactaatttattactntacantagtataactactgtcctacgtacttacgtttcgacgtagggacctacgcgtagganactacgaacgtactggtagcgtcgacactacg

SEQ ID NO: 69627 - DNA, 600 bp, Homo sapiens
  misc_feature: GYAE6OF02I9BAS.51.76.G10.1.454.CMB.1.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaaacctggccaggcctcccaggctcctcatctatgatgctatccacgaacgggccactgatactcccagccaggtcagtgacaggtggtntgggactaggtagttccacgttcctcacctatacagcacgccgtgtcgacgttctacgtaaggttattttagacttaaattttacgttaacttgttacgtagtactaagttaattaaacttaacgttcggtacccgttcccgttaaccgtaccgttttacgggaccgtacggggtaaccgtaacggtccgttacgggtaagtaacgtaaccgtaaaccgtacgtacggttacggtactacggtaccgacctacg

SEQ ID NO: 69628 - DNA, 683 bp, Homo sapiens
  misc_feature: GYAE6OF02FH1MV.51.76.G10.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgtagcagcgtacttagcctggtaccngcagaaacctggccaggcctcccagggtcctcctcatctatgatcgcataccacgaacgggccaacttgactactcccagtccaggtttcaggttggcgtaggtgggtctggggactaggtacgttccacgttctacgaaccactcgacgacgacgccttggacgtacggttccgtacggtaagttaacgttttcggaacttaatttttaaccttacgttcgtacgacgtacgtaagtttaacttaaacgttaaaccgttacggtacccgttaccgtttaaacccgtttacgtttttaccgggacccgttaacgggggaaccctaaacgggtaccggttacgggtaaacggtaaccgttaaaccgaaaacccggttaaccgttaaccgggttaccgggaccgtttacgggtaccctaacccgtttaacccg

SEQ ID NO: 69629 - DNA, 586 bp, Homo sapiens
  misc_feature: GYAE6OF02G8JRJ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggcctcccaggcctcctcatctatgatgcatccaacgacgggccactgactactcccagccctaggttccaggtggctaggttcgggtcgtggggacaggtacgttccacgttctaccacctatcgagcacgctgactagtctagaagttatttgacttaatttacttaactgtacgtagtacgtaagttaataaacgttaccgtcgtacccttaccgttaacgttacgttttacgggaccggtacgggtacctaagggtccgtaggaacgtacgtaaccgaaacgtacgtggtacggtacgtcggtacctacctacg

SEQ ID NO: 69630 - DNA, 683 bp, Homo sapiens
  misc_feature: GYAE6OF02IA4VF.51.76.G10.1.454.CMB.1.raw
  modified_base (198)..(198): a, c, t, g, unknown or other
  misc_feature (198)..(198): n is a, c, g, or t
  modified_base (228)..(228): a, c, t, g, unknown or other
  misc_feature (228)..(228): n is a, c, g, or t
  modified_base (472)..(472): a, c, t, g, unknown or other
  misc_feature (472)..(472): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgctagtctccagcccaccctgtctgtgtctccgaggggaanacgcccacctctcctgcagggccagtcagngtgtagcagcgattacgcttggtaccagcaagaacctggccaggtcctcccgaggccttctcatctatgactgctatccagaacggtccatgactacctccacgtcctaggttccaaggtcggtacgtaggttcggggtacgtacggggtactaaggttacggttccaaccgttccgtaccgaacctagtacccaaggtccgaaccgttccgtgtaccgtacgtaccgttaaggtaaacgtttnttttacggaactttaatttttacgttaacgttcgttaacctacggttaataacgttaattaaaccggttaaccgttccgggtacctttaaccccggttaattaccggttttacgggacccgggtacgggtaaccgttacggacgttaggtaactaacgttaaccgtaaccgttagtcggtaacggttcctacggtacccgtaacttaccgg

SEQ ID NO: 69631 - DNA, 593 bp, Homo sapiens
  misc_feature: GYAE6OF02F377E.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatggacgcagtctccagccaccctgtctgtgtctccgaggggaaagacgccaccctctcctgcagggccagtcagagtgttagcagcgacttagcctggtaccagcagaacctggccaggcctcccaggcctcctcatctatgatgcatccacaagggccactgatactcccagccaggttcaggtcgcaggtgggtcgtgggacaggtagttcgactccgtcaccatcagcacgcctgcgtagtcgtagagtattttgacttaatttattacttgtacagtacgtagttaataagttaaccgtcggtaccttaccgttaacgttaccgttttacgggacccgtaacgggggtaccctaacgggtcggtacgggtaacggaaccgttaaccgaaaaccgttacggttacggtaccggtacgtacggaccctaccgtaaccg

SEQ ID NO: 69632 - DNA, 650 bp, Homo sapiens
  misc_feature: GYAE6OF02FSKGM.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgtagcagcgacttagcctggtaccagccagaacctggccaggctcccgaggctcctcatctatcgatgcactccacgaacgggtccactgactctacccagcctaggttcagtcggctaggtcgggtcgtaggggactaggtacgtttccacgttctaccgacctactaccgacgaccgtacgcccgttacggacgtacgttcgtacgtaacgttagttttacgtaacgttaacgttttactttacgttcgttacgtacgtacgtagttaacgttaacgttaacgttacggttacccgttacccgttaaccgttaccgttttaccggaccggtacggggtaacccgtaacggtaccggtaggtaacggtaacgtaaccgtaaaccgtaacggttacggtacggtacgttcgtaccgaccgttacg

SEQ ID NO: 69633 - DNA, 586 bp, Homo sapiens
  misc_feature: GYAE6OF02JJXZU.51.76.G10.1.454.CMB.1.raw
  modified_base (284)..(284): a, c, t, g, unknown or other
  misc_feature (284)..(284): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacaggggaggaactgctcagttaagacccagacggaaccatggaagccccagcgcagcttctcttcctcctgctactctggctcccagataccactggagaagtagtgatgacgcagtctccagccacctgtctgtgtctccaggggaagagccaccctctcctgcagggccagtcagagtgttagcagcgacttagcctggtaccagcagaacctggccaggcctcccgaggcctccgtnctctatgatgccatccacgaacggccactgatactccagcctaggttcaggtcgtacgaggtcgggtactgggacaggtagttccacgtctcgaccntcacgcacgcctgactagtactagaagttgtttcgtataatttacgtacttcgtacgtagcttaagtaactaagttaaccgtacgtacccgttaccgttacttaacgttttccgggaccgtaacgggaccgtaaggtacgttaggaacgtaacgtaacggtaaaccgtacgtaggtaccggtccgtacgtacccgtaccttaacg

SEQ ID NO: 69634 - DNA, 746 bp, Homo sapiens
  misc_feature: GYAE6OF02INPNA.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgattttagtcactcatacaggggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccaccctctcctgcagggccagtcagagtgttagcagcgtattagcctaggtaccagcaagaaaccgtggaccaggcctacccgaggcctcctacactctagtagacgtgctactaccgaacgaacgggtccactgactacctaccgacgacctacggttcaggttcggacgtagggtacggtcgtaggggactaggtacgttcaccgtctaccgtaaccattaccgacgtccacgtccgtacgccgtaacgttccgttaagtaaggtttaactttttcggaaactttaattttttacgtttaaccgtcggtttaacgaacgtacgttaaacggtttaaaactaaactttaaaccggtccgttacccggtttaacccgttaaaccgttttaaccgttttccggggtaaccgggtaacggggtaaaccccggttaagggtcccgggtttaaacggggtacggttaaacgtaaccggtaaaaacccgggtttaacggttcgggttaacccgggttattacccggtaacccttcccggtttaaacg

SEQ ID NO: 69635 - DNA, 675 bp, Homo sapiens
  misc_feature: GYAE6OF02H3330.51.76.G10.1.454.CMB.1.raw
  modified_base (487)..(487): a, c, t, g, unknown or other
  misc_feature (487)..(487): n is a, c, g, or t
  modified_base (602)..(602): a, c, t, g, unknown or other
  misc_feature (602)..(602): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtcctccacgcccacctgtctgtcgcctcgaggggaacgcgcccaccctctcctgcgacggccagtcgagtacgtagtacgcgagcgtatacgtccgtaggtccacggcaaccgtaaccgtcggaccacggtcctacccgacggccttcccactacgttctagtgactcgactaccgtaccgaacgaaccggccaatacggtactacctacccgacgtaccgtaggtaccgaggtcggacgtcgggtcggtacggacggactagtaccgttccacttccgtaccacgtatcgacacgctccgtgacctggtacgtagtagttacgttntaacttaagtttctagtacacgggttactaagtaaactttagtaaccgttaccggtccgttacccgtttaacgtcggtttaccggttaccggacgggttaaccggtacctacggnggtttaaccggagttaaacccgtaaccggtacgttacggtcgggtaccgtactacccgaccgttacttaccgg

SEQ ID NO: 69636 - DNA, 536 bp, Homo sapiens
  misc_feature: GYAE6OF02HEKN4.51.76.G10.1.454.CMB.1.raw
  modified_base (197)..(197): a, c, t, g, unknown or other
  misc_feature (197)..(197): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (495)..(495): a, c, t, g, unknown or other
  misc_feature (495)..(495): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgtagcagcgacttagcctggtaccagcacgaaaccgtggccacggcctacccaggcctacctccatctatgatgcactccacgaacgggccactgatactccagcagttcagtgcaggtggtcngggacngattcactctacaccatcgancgacncgtcgctacggtctagagtatttcgacttaatttattacgtgtacagtactagttaataacgtaacgtcgttaccttaccgtaacttacgtttcggaccgacggactacggntacggataacctacgaaacgtgtacgtgtcacgtcaccgtc

SEQ ID NO: 69637 - DNA, 607 bp, Homo sapiens
  misc_feature: GYAE6OF02IZR0M.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgttagcagcgacttagcctggtaccagcaagaaacctggccaggcctccccaggcctcctcatctatgatgctatccaacgacgggccactgactactcccagcctaggttcagtcgggactagggtcgggtacgtggggaactaggtacggttccaaccgtttcctacccaccgtacttaccgaacggaccgaacggtccctggaccgtagtccgtaggtaagttagtttagtacttaattttacgttacttcgtacagtactaagttaactaacttacgtcgtaccgttaccgttaccttacgttttccgaaccggtacgggtaacctaggctaggtaacgtaactaacgaacgtacgtgtacggctcggaccacctacg

SEQ ID NO: 69638 - DNA, 549 bp, Homo sapiens
  misc_feature: GYAE6OF02GU620.51.76.G10.1.454.CMB.1.raw
  modified_base (517)..(517): a, c, t, g, unknown or other
  misc_feature (517)..(517): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcccgattagcctggtaccagcagaacctggccaggcctcccaggcctcctcatctatgatcgcactcccaacgaacgggccacgtgaactactcccgagccctaggttcaggtcggcgtagggttcgggtcgtggggaacctaggtacgttcaccttcctacaaccatcacgcgacgcctgctagtcgtagtaattagtttacgacttaatttatactgtacagtactaatataatactcgtacctacgtacttacgttcgacgtaggtactaggctagganacgtaacaacgtacgtggtgtctacgacactc

SEQ ID NO: 69639 - DNA, 718 bp, Homo sapiens
  misc_feature: GYAE6OF02JQN4J.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctcctcctgcacgggccagtcagagtgttagcagagacttagctggtaccagcagaaacctcggcacggctcccaggcctcctacgatcatcgatcgcactccaaccgaacgggaccacgtagactactacccgacgtaccgtacggtttacgaaggtttcgggaccgtaagggttcggggtaccggtacggggtaacgtacgggtaacgtttaccgtaaccgtccgtttaccaacccggtactaccgtaacgacccgttaacgcccgttacggacgtaacggtacgtaacggtaaacgtttaacgttttaaccggttaactttaaacttttaacgttactttacgtaacgtaggtaccgttaagttaacgttaaacgttaacgttccgggtaccttaccgttaaccgttacgtttaccgggaccggtacgggtaccgtaacggtccgttaggtaacgacgtaacggaaccgttacggtcggtacggtaccgtacggtacccgtacttaccgg

SEQ ID NO: 69640 - DNA, 656 bp, Homo sapiens
  misc_feature: GYAE6OF02IHG4I.51.76.G10.1.454.CMB.1.raw
  modified_base (196)..(196): a, c, t, g, unknown or other
  misc_feature (196)..(196): n is a, c, g, or t
  modified_base (634)..(634): a, c, t, g, unknown or other
  misc_feature (634)..(634): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccacctctcctgcagggccagtcagtagtgttagcagcgattagcctggtaccagcaagaaacctggccagcctcccaggcctctcatctatgatgacactaccacgaacggccactagactaactcccgacgtccgtaggttacctaggtcggacgtagggttcgggtacgttacggggactaaggtacgttctactcctaccgaacctatcgaacgctaacgcctgacctagtacttaggaagtttcgtttacggtaacttaactttttacgttacgtagtactaacgacttaagttaaactaaacgtttaaaccgtcgggttacccttaacccggttacttaccggttttaaccgggaccggtaccgggtaacctacgggtccggtaaggtacgtaaactaaccggaaaacggttacgttacgggtaccggngttaaccgcctaaccgttaccg

SEQ ID NO: 69641 - DNA, 824 bp, Homo sapiens
  misc_feature: GYAE6OF02HFD46.51.76.G10.1.454.CMB.1.raw
  modified_base (197)..(197): a, c, t, g, unknown or other
  misc_feature (197)..(197): n is a, c, g, or t
  modified_base (299)..(299): a, c, t, g, unknown or other
  misc_feature (299)..(299): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcgaggccagtcagagtgttagcagcgacttagcctggtaccagcaacgaaacctggaccaggcctacccgaggctcctacatctangatcgacatccaacgaacgggcctacgtgtaactacgtccaacgaccgtaggttcaggtgaccgtaaggttcggggtactagggggtaactagggtacgtttacacgtacctttaccgaaccctaaagttccgaacggtaccaaccggtcccgttacggtacgtaaacggttaccgttaaggggttaaaccgtttattttttaaccgggaaacctttttaaaagttttttaaccgttttaacccggtttacgttaccggtaaaacggtaaccgtttaaaagggtttaaacttaaaaaaccggtttaaaccggtttaccgggtaaacccccctttttaacccgggttaaaccgttttaacccgggttttaacccggggtacccggaaacgggggggttaacccctaaacgggggtccgtaaccgggggtaaagttaaacccggttaaacccgtaaaaaccgggttaccggttttaacggggtaccggttaaccggttaacccggtaacccgtaaccgtttaaccgg

SEQ ID NO: 69642 - DNA, 685 bp, Homo sapiens
  misc_feature: GYAE6OF02HHHLH.51.76.G10.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagcgatcgtatacacgaccggtgctcgatttagtcactcatacagggggaggaactgctcagttaggacccagacggaaccatggaagcccccagcgcacgcttctcttcctcctgctactctggctcccgagactaccactggagaagtagtgatgacgcagtctccagcccaccctgtctgtgtctccgaggggaaancgccaccctctcctgcaggccagtcagngtgtagcagcacttagcctggtaccagcagaaacctggaccaggcctcccaggctcctcactctatgatgcactccaagaacgggccactgtatactcccgagccgtacgttcagtggacgtaggtgggtcgtagggactaggtacttccgtactcctccgaacctactaccgacgtccaacgtcccgttaggacctaaggttactaacgggtaaagtttagtttttacggaaccttttaaagtttttacgtttaacgttagtaccgtaaggttaccttaaacggtaattttaaacgtaacggttaccggtacccgttttaacccgttaaccgtttaccggtttttacgggacccgggttaacggggtaacccgtacggtaacggtacgggtaacgtacgttaaacccgaaacggttacgttagggtaccggtacgtacgtaccgtaaccttacg

SEQ ID NO: 69643 - DNA, 655 bp, Homo sapiens
  misc_feature: GYAE6OF02JFEAK.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgacttagcctggtaccagcagaacctggccaggctcccagctcctcatcatgatgcatccgacacgggccactgatctccagcctaggttcaggtgcctaggtcgggactgggacaggtacgttacaccgttctaccaacctacgttaccgacgtaccgaacggcccgttcggtacgtacgttcgttaacggtaacggtttagttttagtacctttaaagtttttaacgttacgtttacgtaccgtagtaccttaaagttaacttaaacgttaacggttaccggtaccctttaaccggttaaccgtttaccggttttacgggaccgtaccggggtaaccgaacgggttccggtaggtaacgtaacgtaaccgtaaacggtaacgttacggtacggtaccgtacgtacccgtacttaccg

SEQ ID NO: 69644 - DNA, 563 bp, Homo sapiens
  misc_feature: GYAE6OF02GXD8G.51.76.G10.1.454.CMB.1.raw
  modified_base (196)..(196): a, c, t, g, unknown or other
  misc_feature (196)..(196): n is a, c, g, or t
  modified_base (417)..(417): a, c, t, g, unknown or other
  misc_feature (417)..(417): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaacctggccaggctcccaggctcctcatctatgatgcatccacgaacgggccacgtgactactccccgagcctaggttcaggtcggctaggttgggtcgtaggggactaggtacgttcactcctacaccataccagcacgtcctgcacgtcgtagaagttntttcgacttaatttattacgtgtacagtactagttataactacgtcgtaccttaccgtacttacgtttcggaccgtacgggtaccaggtcgtaggtacgtaacgtaacgaacgtacgttaggtacggacgtacgtaccgacctacg

SEQ ID NO: 69645 - DNA, 662 bp, Homo sapiens
  misc_feature: GYAE6OF02JINEF.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggaggaactgctcagttaggacccagacggaaccatggaagccccagcgcagcttctcttcctcctgctactctggctcccagactaccactggagaagtagtgatgacgcagtctccagccaccctgtctgtgtctccgaggggaaanacgccacccgtctcctgcaggccagtcagatgtacgcagcgaacttgcccgtaggtaccagcacgaacctggccaggcctacccgaggccctcctctactttatgattggctataccgaaaggttcgttggctacgtcccgagtcccgaggttcgaggttggcgtaaggttcgggtcctaggggacaggtaacttctacgtcctacgacctataccacgacgactacgacgtccgtagtacgtacgttttcgacgttacgtttacttacgttcgttaccaagtaccgtacgtaaccgtaaccgtaacgttcggtccttaccgttccgtttacgggaccgggtaacgggtaccggtaacggtacggtacgtaacgtaccgaaaccgttaccggttaggtaccggtcgttacgacccgtaccggtacttcggttaccgttaccttacgttcccttaccgttacccccg

SEQ ID NO: 69646 - DNA, 546 bp, Homo sapiens
  misc_feature: GYAE6OF02H5M7B.51.76.G10.1.454.CMB.1.raw
  modified_base (196)..(196): a, c, t, g, unknown or other
  misc_feature (196)..(196): n is a, c, g, or t
  modified_base (418)..(418): a, c, t, g, unknown or other
  misc_feature (418)..(418): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatatcccagccaggttccagtggcagtgggtctgggacagagttcactctacaccatcagcagcctgcagtctgaagtattttgactaatttattactgtacagtnaagttataacttaactggtacccttccgtaacctacttttcggacctagggggtaaccctaaggcgttacgggagtaactaccgaaaacgtaacgttacggttaggtaccgtaggtaccaccgtaacg

SEQ ID NO: 69647 - DNA, 720 bp, Homo sapiens
  misc_feature: GYAE6OF02FK9CK.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgtagcagcgacttagcctggtaccagacaagaaacctggccgacggcctcccaggcctcctcactctatgactcgcactaccgacgaacgggccagtacccccgaatacctacccgacgccgtacggttccgtaggtcggtacgtaggtcgggttcggtcgggtaacgacggtacgtttaccgaccgttcctacctaaccctacgttaccgacgtcctaacggcccgttacgtaccgtaacggttccgtaacggtaaacggtttagttttacgtaactttaaacttttaactttaacgttcgttaccgtacgttaacgtaacgttaacgttaaacgtttaaaccgttacggttacccgttacccgtttaaaccgtttaccggtttacgggtacccggtaccgggtaaccgtacggtaacggtacgggaacggttaacgtaaccgtaaacgtaacggtacggttacggtaccgtcgtacccgtaccgtaaccg

SEQ ID NO: 69648 - DNA, 659 bp, Homo sapiens
  misc_feature: GYAE6OF02HW16I.51.76.G10.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (233)..(233): a, c, t, g, unknown or other
  misc_feature (233)..(233): n is a, c, g, or t
  modified_base (370)..(370): a, c, t, g, unknown or other
  misc_feature (370)..(370): n is a, c, g, or t
  modified_base (386)..(386): a, c, t, g, unknown or other
  misc_feature (386)..(386): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgganaagtagtgatgacgcagtctccagccaccctgtctgtgtctcgaggggaaanagccaccctctcctgcaggccagtcagagtgttagcngcgattagcctaggtaccagcaagaaacctggaccaggcctacccgaggcctcctcactctatcgtactcgacatccaacgacggaccactagactactcccgagcctaggttcaggtgactggtggtctgggaacngtacgtttcacgttcncaaccgatcgacgtcacgtctaggctacgtatacggtaagttatttacgacttaagttttacttacgtatactacgtacgtagttaactaaacgttaaccgtcgtaaccgttttacccgtaacgtttaaccggttttaccgggacccggtttaacggggtaacccgtagggtaccggttacgggaaacgttaaccgttaaaccggtaaacccggtttaacggttacgggttaccggtaaccccggtttacgtaacccgtaacccgtttaaccg

SEQ ID NO: 69649 - DNA, 594 bp, Homo sapiens
  misc_feature: GYAE6OF02F5GYS.51.76.G10.1.454.CMB.1.raw
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (369)..(369): a, c, t, g, unknown or other
  misc_feature (369)..(369): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaagagccaccctctcctgcagggccagtcagagtgttagcagcgacttagcctggtaccagcaagaaacctggccaggctcccaggctcctnatctatgntgcatccaacgaagggcccatgactactcccagcctaggttcagtcggctaggtgggtctgggacagtgttcactcncaacatcagcacgtcctgcacgttctagaagttacttttcgacttaacttttatttacctgttacacgtacgtaagttaataaacgttaacgttcgggtaccttacccgttaacgttaaccgtttttacgggacccgtacggggtaacccgtaacggtcgttaacggacggtaacgtaaccgaaacggtaacgttggtaccgggtctacggtacccaccttacgg

SEQ ID NO: 69650 - DNA, 719 bp, Homo sapiens
  misc_feature: GYAE6OF02GBOGJ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgtagcagcgacttagcctggtaccagccaagaaacctggaccaggcctacccgaggtcctcctacatctatgatcgcactccacgaacggccacgtgactacgtccagccgtaggttcaggtcggcgtagggtcgggtcgtacggggactaggtacgtttccaacgttcctaccgacctagtaccgagtaccgaacggtcccgtacggtacctacggttacgtaacggtaaacggtttactttttacggaacttttaaatttttacgtttaacgtttacggttaactaacggttaactaacggtttaaagttaaaccgtttaaaccggttacggttacccctttaaccggttaaccgtttaaccggttttacggacccgggttaacgggtaacctaacgggtacggttaacgggtaaacgttaaccgttaaacgtaaaaccggttacggttacgggttaccggacctttaaccgggacctaaccgtaccg

SEQ ID NO: 69651 - DNA, 597 bp, Homo sapiens
  misc_feature: GYAE6OF02GUJFB.51.76.G10.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (346)..(346): a, c, t, g, unknown or other
  misc_feature (346)..(346): n is a, c, g, or t
tcagcgatcgtatacacgaccggtgctcgatttagtcactcatacagggggaggaactgctcagttaggatccagacggaaccatggaagcccagcgcagcttctcttcctcctgctactctggctccagataccactggagaagtagtgatgacgcagtcctccagcccaccctgtctgtcgtctccgaaggggtaaanacgcccaccctctcctgccgagggccaggtcagagtgttagcagcattgctgacagcagaacngcagcnccagctccnatctatgatgcatccaagaacggccacttgatactccgagcctaagttcagtcggactagtcggggtnaggtacagtacgttcgaacctttgaccacctaatccagacacgtccgtagcctaagtccgtagtaacggtattttcggaactttaactttaagttactaggtcctaagtacaagttaacttaaacgttaacgttcgtaccccttaacggtaacctttacgttttaccgggaccgtaaccggggtaaccgaaggtcctaggtaacgaacgttaaccgaaacgttacgtaggtacgaccgttagacccgtaac

SEQ ID NO: 69652 - DNA, 624 bp, Homo sapiens
  misc_feature: GYAE6OF02IL5YD.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcaagaacctggccaggcctcccgaggctcctcatctatgatcgcatccacgaacgggccacgtgactactcccagcctaggttcagtggcaggtcgggcgtgggactaggtagttccgacttccgtacaacctatcacgacgacgtccgtagacgtacgttcgtagtaagtttacttttcgaactttaaacgttttacttacgttacgtacgtacggtacttaaggttaacttaaacgttaacgttcggtaccctttaccgttacgttaacgttttccgggaccggttacgggaacctaggtcgttacgggaacgtaaccgttaaccgaaacggttacgttacggtcggttacgcgtaccgaccttacg

SEQ ID NO: 69653 - DNA, 611 bp, Homo sapiens
  misc_feature: GYAE6OF02HYMVX.51.76.G10.1.454.CMB.1.raw
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctccgaagggggaaagagcccaccctctcctgcgagggccagtcagagtgttagcagcgacttagcctggtaccagcaagaaacctggccaggcctcccgaggcctcctacatcttatggatgcatccaacgaacgggccactgactatcccagccaggttcgagtcggacnggtgggtcgtgggacagtagttcactcncaaccgtatcacgcacgccgtgctagtctagtaagttagttttagtacttaaattttatttaacgttctacgtagtactaagttaacttaaagttaaacgtcggtaccgttaccgttaccgttaacccgtttttgggacccggtacggggtaaccgaaggtccgttagggaacgtaacgttaaccgaaacgtaacgtaggttccgtaccgtacgtacccgacgtaacg

SEQ ID NO: 69654 - DNA, 637 bp, Homo sapiens
  misc_feature: GYAE6OF02JOTNQ.51.76.G10.1.454.CMB.1.raw
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccagccaccctgtctgtgtctcgaggggaanacgccaccctctcctgcacgggccagtcagngttgtacncagcgacttagcctaggtaccagcaagaacctggccacggcctcccgaggcctacctcacttcagtgatcgcgactccacgacggccagtgactactaccagtccgtaggttccaggtcgacgtaggtggtacgtgggaactggtacgttcaccttcgtaccaacctacgtaccgagaccgtacgaccgtacgctacgtacgttacggtaagttacgttttagacgtttaacttttacgttaactacgtacgtaagtactaagtttaaattaacgttaacgtacgttaccttaccgttacttaacgtttaccggaccggtacgggtaaccgtacggtacgttacggaacgttaacggtacgtaaaccggtacgtcggtacgtacgtacggtaccgtacgtaacg

SEQ ID NO: 69655 - DNA, 616 bp, Homo sapiens
  misc_feature: GYAE6OF02IDDF4.51.76.G10.1.454.CMB.1.raw
  modified_base (197)..(197): a, c, t, g, unknown or other
  misc_feature (197)..(197): n is a, c, g, or t
  modified_base (357)..(357): a, c, t, g, unknown or other
  misc_feature (357)..(357): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggcctcccgaggcctcctcatctatgatgcatccagacgggccatgactacgtcccaagcctaggttcaggtggacctaggtgggtcgnggggactaggtattccacttcctaccaccatccgacgccgaacgtcccgtcgacgacgttacgtggtaaacgtttagttttcgtactttaaatttttacgtttacgttagtactaggtactaaggttaattaaacgttaaccgttaccggtacccgtttacccgtaacgtttaccgtttacgggacccgtaacggggaaccctaaggtccgtaggaacgtacgtaaccgaacgtacgtgtacggctacgacctacgtac

SEQ ID NO: 69656 - DNA, 857 bp, Homo sapiens
  misc_feature: GYAE6OF02FYXGC.51.76.G10.1.454.CMB.1.raw
  modified_base (119)..(119): a, c, t, g, unknown or other
  misc_feature (119)..(119): n is a, c, g, or t
  modified_base (388)..(388): a, c, t, g, unknown or other
  misc_feature (388)..(388): n is a, c, g, or t
tcagcgatcgtatacacgaccggtgctcgatttagtcactcatacagggggaggaactgctcagttaggacccagacggaaccatggaagccccagcgcagcttctcttcccctcgtcncttactcgtcgtcctccagacctacctagtaggaagtaaggtagtagatcggacgacgtagttcctaccgaccgacccctaccgttcgtcgttcgtacgttcccgtacgggaaaggggaaacgtccgacccctaccctcctcgtccgacggaccggtacgtacgtacgaacggttaggttgtaacgcggacgtcggtaacttaccgccggttacggaccagaccgaacgtaaccggtccgaccgacgtccctaccggacgtcctccctntactcgtagtacgacgtcgtaccaccgaccaaaccgggaccggtacctaacgtagtaacgtaccccgtaaccgtaccgtcgttaacgggttacacggggttacgacgggttcgggtcgggtacgtacggggactaacgtcggttaccctacgtacctacccgacttacgacgaagtccgtaacgtcccgtacggaccttaggtaccgtaggtaagttttacgttacgacttttaaacgtttacgtaactttccggtaaccgtaggtacccttaaaggttaacgtaaacccggttttaagtcccggttaaccccgttaccgttaaacccggttttcgggtaccccgttaacgggggtaacccgacgggttaaacccggttgggtacgggtaaactaacccgggttaaccggtaaacggttaacccggtggggttaaacccggtcgttacggaaccccgttaaccggttcc

SEQ ID NO: 69657 - DNA, 536 bp, Homo sapiens
  misc_feature: GYAE6OF02FKMDP.51.76.G10.1.454.CMB.1.raw
  modified_base (196)..(196): a, c, t, g, unknown or other
  misc_feature (196)..(196): n is a, c, g, or t
  modified_base (317)..(317): a, c, t, g, unknown or other
  misc_feature (317)..(317): n is a, c, g, or t
  modified_base (394)..(394): a, c, t, g, unknown or other
  misc_feature (394)..(394): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacgaagggccactgatancccagccaggttcagtggcaggtgggtctgggacaggagttcactctacaccatcagcagcctgcagtctagaagtntttgactaatttattactgtctagacagttataattaactcggtaccttaccgttactacgtttcgaccgtacggggaaccgacggtcgtaggtagtaacgtacgaaacgtaacgttcggtaggtacgtcgtacgacctacg

SEQ ID NO: 69658 - DNA, 738 bp, Homo sapiens
  misc_feature: GYAE6OF02I2Y8U.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgttagcagcgacttagcctggtaccagacaagaaacctggaccaggcctccccaggcctcctcatctatgatgcatccaacgaaggccagtgatactccagccaggttcaggtggctaggtcggtacgtgggactaggtagttaccacttccgtaccaaccgtactcgaagtccgaacgtccctaggacctacggttccgtaaggtaaacgttaagttttacggtaacctttaaagtttttaactttaacgttacggtaccgttaaacggtacgttaaacgtttaaacgttaaaaccgtttaaccggtttaccgggttaaccccctttaaaccgggtttaacccgtttaacgggtttttacccgggtaacccgggtaaaccggggggttaacccctaaacggggttaccggttaacgggggaaacgttaaacccgttaaaccggaaaacccggtttaacgtacggggttaaccggtacccggtttaacggaccccttaccgttaaccgg

SEQ ID NO: 69659 - DNA, 827 bp, Homo sapiens
  misc_feature: GYAE6OF02I0ZJL.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccacgtggagaagtagtgatgacgcagtcctccagcccaccctgtctgtgtcctaccgaggggaaagcgcccaccctctcctgcgagggccagtcagagtgttagcagcgacttgcctggtacagcagaacctggacccaggccctaccccgaggtccctcccgtactacgtcttaacgtagacgttacggacctaaccgtacccgaaaccggtaacggggacccaaccgtttacggaacttaaccttccccccgaacggtccccggttaagggttttaccaaggggtttacgggaccgtagggggtttccggggttacggtttacgggggaaactaggggtacggttttacccaaccgtttcccgttaacgacccggttaacaccgtacggtaaccgtaccggtccccgtaggccgtaacggttcccgttaaaggtaacggtttacgtttttacgaacgttttaacttttaacgttacgttacgtaaccgtacgaacgttaagtttaaacgttaacggttaaccgttacggggttacccctttaaccggttaaaccgtttaccggttttaccgggaacccggggttacgggtaaacccgtaaccggggtcgttaacgggaaccgttaacgtaaaccccgtaaacggtacggttacgggttaccggtaacgtaccggtacccgtaccgttacg

SEQ ID NO: 69660 - DNA, 558 bp, Homo sapiens
  misc_feature: GYAE6OF02H3H7L.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagagtgttagcagcgtacttagcctggtaccagcaagaaacctggccaggctcccaggctcctcatcctatgatgctactccaacgacgggccactgactactccagtccaggttcagtgcgagtggtctgggacagtagttcactcgtacacctatacgagcacgcctgctagtctagtaagttatttcgaaccttaatttacttacgtgtacctaagtactaacgttaattaacgtaacgtccggtaccttaccggtacttacgtttcggaccgtacgggacctaggctaggatacgttaaccaagtacgtggtaccgtcgtagacctactacg

SEQ ID NO: 69661 - DNA, 578 bp, Homo sapiens
  misc_feature: GYAE6OF02HT7E2.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccacctctcctgcagggccagtcagagtgttagcagcgacttagcctggtaccagcagaacctggccaggcctcccaggcctctcatctatgatgcatccacgaaggccatgatactccgagccagttcaggtcgacaggttggtcgtgggaacagtacgttccacgtctaccacctatactacgacacgcctgacacgtactagaagtatttacgtacttaatttacttaacttgtactagtactagttaactaataacgtcggtaccttaccgttaccttacgttttacggaccgtacgggtaacctaacggtacgtacggaacgtaacgtaacgtaaacgtaacgtaggtacgtacgtacgtacgtaccgtacg

SEQ ID NO: 69662 - DNA, 556 bp, Homo sapiens
  misc_feature: GYAE6OF02FROGZ.51.76.G10.1.454.CMB.1.raw
  modified_base (181)..(181): a, c, t, g, unknown or other
  misc_feature (181)..(181): n is a, c, g, or t
  modified_base (434)..(434): a, c, t, g, unknown or other
  misc_feature (434)..(434): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtntctcaggggaaacgccaccctctcctgcagggccagtcagagtgtagcagcgacttagcctggtaccagcagaacctggccaggctcccaggctcctcactactatcgatgcagtccacaacgggccactgactacgtccagctaggttcaggtggcaggtcgggtctggggatagacgttcgactcttacgacactacagccatccagccatcgtggaattcgtttagacttaattttcttaacttcggtanacgtcgtaagttataacttaaggtcacccggttaactacgtttacgttacggaccgtagggaaccacggtgtacggagtacctacgaacgtaacgtggtaacggcgtacgaccgtaccctag

SEQ ID NO: 69663 - DNA, 595 bp, Homo sapiens
  misc_feature: GYAE6OF02IKV2B.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgcccaccctctcctgcgagggccagtcagagtgttagcagcgacttagcctaggtaccagcaacgaaacctggaccaggcctcccgaggcctcctcatctatgatgacactccaacgaacgggccacgtgaactacctccgagccgtaggttcaggtggcgtagggttcgggtcgtagggacaggtacgttccacttcctccaacctagtacacgcacgtcctgactacggtcgtagtaagtttagttttagtactttaattttacttacttacgtactagtactaagttaataaacgttacgtcgtaccttacgttacttacgtttcgaccgtacgggactaggcgtaggacgtacgtaacgaaacgtacgtcggtcgtacgtcgtacctactacg

SEQ ID NO: 69664 - DNA, 577 bp, Homo sapiens
  misc_feature: GYAE6OF02H35FS.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaacctggaccaggctccccaggtctcctcatcgtatgatgcatccacgaagggccactgatactcccagccgtagttcaggtggacaggtgggtcgtggggactaggtacgtttcactcctacaccgatcgagcacgcctgctagtctagtaagtttatttagtttaatttattacttagtacagtactaagtaataagtaacgttacggacccttaccgttaactacgttttacgggccgtaacgggtaccgtaaggtacgtggtaacgagtaccgtaaacgtacgttaggtacggcgtcggactaccgtacttacg

SEQ ID NO: 69665 - DNA, 756 bp, Homo sapiens
  misc_feature: GYAE6OF02IP5IF.51.76.G10.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
tcagcgatcgtatacacgaccggtgctcgatttagtcactcatacaggggaggaactgctcagttaggacccagacggaaccatggaagccccagcgcagcttctcttcctctgctactctggctcccagataccactggagaagtagtgatgacgcagtctccagccacctgtctgtntctcgagggaaancgccacctctccgtgcgacggccagtcagtagtgtancagcgattagcctaggtaccagcaacgtaaccgtcggaccacggacctaccccgaaggtccctcccgttacaacttccgttaagtacgtacttacggacctaactaccccgaaggtaaccgggacccctaaaggttacgaacgttaccgtacccgacggtacccgtagggttacgaacggtcgggacgtacgggttacgggttaccgtaggggtaacgaacggttacggtttaccaccttacctaccgtaacgtactccgaaagtcccacggtacccgtagtacgtaacgttcggtaaacggtaagtttacgttttacggtaaacttttaactttttaaacgttacgttacgggtacttaaagtaccgttaaaggtttaacctttaaccgaacggttccggttaaccgttacccgttaagttaccgttaccgggaacccggttagggaacctacggtaacggtaacggtacgtaaagtaaccgtaacggtacggtcggtacgtacgttacgacccgtacgttaaccg

SEQ ID NO: 69666 - DNA, 561 bp, Homo sapiens
  misc_feature: GYAE6OF02I4ZWK.51.76.G10.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgtagcagcgacttagcctggtaccagcagaaacctggccaggctcccaggctccncatctatgatgccatccaacgaacgggccactgactactcccagcctaggttcaggtgcgagttgggtcgtgggactaagtcgttacactcctcgaccatcgagcgcgtccgtgacacgtctaggtaattagtttagacttaatttattacgtgtacgagtacaagttaataacgttaactcggaccttacgtactacgtttacggaccgacgggtacaacggtcgttaggaagtaacttacgaaacgttaacgtggtagtccgtactaccgtacgtac

SEQ ID NO: 69667 - DNA, 533 bp, Homo sapiens
  misc_feature: GYAE6OF02GV2EO.51.76.G10.1.454.CMB.1.raw
  modified_base (196)..(196): a, c, t, g, unknown or other
  misc_feature (196)..(196): n is a, c, g, or t
  modified_base (284)..(284): a, c, t, g, unknown or other
  misc_feature (284)..(284): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctnatctatgatgcatccacaagggccactgatatcccagccaggttcagtgacagtggtctgggacagagttcactctacaccatcagcagcctgcagtctagagtatttgactaatttattactgtcagctagtataataacgtcgtacctccgttactacgtttacggacctaggggacctaacggtcgtaggaacgtacgttaacgtaaaaccgtaacgttggtacggtacgtcggacctacctaacg

SEQ ID NO: 69668 - DNA, 721 bp, Homo sapiens
  misc_feature: GYAE6OF02JFJKG.51.76.G10.1.454.CMB.1.raw
  modified_base (194)..(194): a, c, t, g, unknown or other
  misc_feature (194)..(194): n is a, c, g, or t
  modified_base (470)..(470): a, c, t, g, unknown or other
  misc_feature (470)..(470): n is a, c, g, or t
  modified_base (702)..(702): a, c, t, g, unknown or other
  misc_feature (702)..(702): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccacctgtctgtgtctccgaggggaanacgccaccctctaccgtgcagggccagtcagacgtgttagcaggcgacttacgcctaggtaccagcaagaacctggaccagggcctcccgaggtcctcctctatctaagtgatcgctatcccgaacgtaacgggaccctaacgtaggtaacctaacgttaccccgaacggtaccccgtaacggttttccgaacgggtttcgggaccgtaaggggtttcggggttaccggttaggggaacgtacggtaacggtttaccaccttccgtaaccaccgtntacccgaggaccctaaggtccctaggacgtacgttcgtaagtaagttagttttagaactttaattttacgtacgtttgaactagtaccgtaagtttacgaaacgttaacgtccgggttaacccttaccgggttaaactttaccggggttttccggaaccgtaccggggtaaccgtaaggtcccgggttaaggaaccgttagtaaaccggtaacggtaacgttgggtaccgtntaccgggacccttactacg

SEQ ID NO: 69669 - DNA, 838 bp, Homo sapiens
  misc_feature: GYAE6OF02JW5L3.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggcctcccagactaccactggagagtagtgatgacgcagtctccagccacccgtgtctgtgtctaccgaaggggaagacgccaccctctcctcgacgacgggaccagtcgaggtgtagttagcgacggacgtacgttacgccgttacggtaccaggtaccaacggaaaccgtcgggacccaaggtccctaccccggacggtccttccgtactaccttacgtacggtgtacgtcggacctaacgtaccccgaaacggaacccgggtacctacgtaggtaacctaccgtacccgaaccggtacccggttaaggttccggtacgggtacggtaccggtaggggttcgggttaccggacggggtaactaacgggttaccttacccgtaccgtacctaaccaccgtatccgaacgtcgtaacccggtcgttacggaccttaacggtcgtttaacggtaagttttacgtttaacgttacgtttaaaagtttttccgtacgttttacggtaccgtaagttaacgtttaaacgttaaccgtttaaacgttaacccggttcgttaacccccgtttaaccgttacggttttacccggtttaccggggaacgggttacccgggtaaaccgtttacgggaccggttaacgggttaaccggaaacgttaaaccggttaacccgggtacggttacggttacccggtacgtaccggtaccctacgttaccg

SEQ ID NO: 69670 - DNA, 638 bp, Homo sapiens
  misc_feature: GYAE6OF02GPUPU.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagngcccaccctctcctgcagggccagtcagagtgttagcagcgtacttagcctggtaccagcagaaacctggccaggcctcccaggcctacctcacttctatgatcgcactccgaacgaacgggccaacgtgaactctcccgagtcctaggttcaggttcggcgagggttcgggtcgtagggggactaggtacgtttcaccgttcctaccgaccatccgacgcacgcccgtgacgtagtctacggtaagttattttacgtactttaattttattacgttgtacgtagtaactaagttaattaaattaccgtacggttacccgttacgtacctttacgtttccggaccgtacggggtaacccgtaaggtccggtaagggtaactaacgtaacccgtaaacggttaacgtcgggttacggaccgtacggtaccctacgtaacg

SEQ ID NO: 69671 - DNA, 558 bp, Homo sapiens
  misc_feature: GYAE6OF02FMN9J.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccagggggaaangccaccctctcctgcagggccagtcagagtgttagcagcgacttagcctggtaccagcagaacctggccaggctcccaggctcctcatctatgatgcatccacagggccatgatactccagccaggttcagtgcagtgggtctgggacagacttcactctcaccatcacgcagcctgcatctagaagttatttcgacttaattttattacgtgtacgagtacaagttaacgtaattaaccggtcgtacccgttaccgttacgttcgttacggacccggtagggtaaccgtaaggtcgtagggtaacgtaacgtaaccgtaaaccgtcggtacggtccggtacgtcgtaccgtaccgtaacg

SEQ ID NO: 69672 - DNA, 777 bp, Homo sapiens
  misc_feature: GYAE6OF02G3SMU.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgtagcagcgacttagcctggtaccagcaagaaacctggaccaggcctacccgaggcctcctcacttcgtatgatgacctactacccaacgaacgggccctacgtagactactcccgagcccgtaggttcaggtcggacgtagggttcgggtcgtaggggaactagggtacgtttaccaccgttccgtaccaaccgtacgttacccgacgtacgaccggtcccgtagaccgtacgttacgttaaggtaaacgtttacgttttacggtaaccttttaaagtttttaacttaaccgtttaggtaccgtaacgttacgttaaacgtttaaacgtttaaacgttaaccgttacccgggttaacccgttttacccggtttaaaccgttttaaccgggttttttaccggggaaccccgggtttaaccgggggaaacccgttaacgggttacccggggttaagggtaacccggttaaacgttaaacccggaaaaaccgggttaccggttcggggttaccggtaccgttaaccgggtaccccgtaaccgtttaccggg

SEQ ID NO: 69673 - DNA, 619 bp, Homo sapiens
  misc_feature: GYAE6OF02GI6J1.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccgaggctcctcatctatgatgcatccaacgaacgggccaacgtgatactcccagcctaggttcagtcggctaggtcgggtcgtagggactaaggtagtttccacgttccacaccactcacgcacgcctgcgtacgtcgtacgtaagttattttacgactttaagtttattacgttcgtacgacgtacgtaagttaataaacgttaacgttacgtacctaacgttacccgttaacgttaccgttttacgggacccgtacggggtaacccgtaaggtaccgttagggaacgttaacgtaaccgtaaaccggtacggttaggttacgggaccttacggaccctaacccg

SEQ ID NO: 69674 - DNA, 577 bp, Homo sapiens
  misc_feature: GYAE6OF02F35DN.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtccagagtgttagcaggcgtacttagcctggtaccagcagaaacctggccaggctcccaggctcctcatctatgatgcatccacgaacgggccactagactactcccagcctaggttacagtggcgtaggtcgggtacgtagggactaggagttccacgtcctacacctactcacgccgacgcctcgccgtagtcctaggtaagttacttttagacgttaatttactttaacgtgttaccgagtactagttaactaagtaacgttcggaccttcgtacttacgtttacggcccgtagggaccgtaggtcgtaggagtactaccgtaacgacttaggtcgtcgtacgtacaccttacg

SEQ ID NO: 69675 - DNA, 550 bp, Homo sapiens
  misc_feature: GYAE6OF02F6ZRZ.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaacctggccaggctcccaggctcctcatctatgatgcatccacgaacgggccaactgatactcccagccaggttcagtggctaggtgggtctgggacaggacgttcactctcacatcagcagcctgctagtctagagttatttcgacttaatttacgttacttgtactagtctaagttataaactaacgtcggtaccttacgtacttacgtttacggaccgtaggggacctaggtaccgtaggtaacgaacttaaccgaaacgacgttaggtacggactcgtaccacgtacg

SEQ ID NO: 69676 - DNA, 708 bp, Homo sapiens
  misc_feature: GYAE6OF02JM1OL.51.76.G10.1.454.CMB.1.raw
  modified_base (184)..(184): a, c, t, g, unknown or other
  misc_feature (184)..(184): n is a, c, g, or t
  modified_base (387)..(387): a, c, t, g, unknown or other
  misc_feature (387)..(387): n is a, c, g, or t
tcagcgatcgtatacacgaccggtgctcgatttagtcactcatacagggaggaactgctcagttaggacccagacggaaccaatggaagccccagcgcagcttctcttcctctgctactctggctcccagactacactgagaagtagtgatgacgcagtctccagccaccctgtcctgtcgtcnccgtaggggaaagacgcccaccctcctcctgccacgggcctacgtccgagtacggtacggttagccgacggcgtaacgtttacgccgttacggtacccgaagaccgaacgtaaaccgtacggcccgacggaccgtcccgaccggtccgtccctctacgtactcggaacttggccaatgccctacaacgggccaacgtgactancccagcccaggttccaaggttcggacgtaggtcgggtactggggactaggacgttcaccgttctaccgacccacgttccagcccaaggccctacgcctagtccctggtaacgagtttttacggacttaaaggttttcttaaaccgttggttaacctaaggtacctaaggttactaaacgtttaaaccttcgggtaaccctttaccggttaaccctacgtttttaccgggacccttagggggtaccctaacgggacttccgggaaacgtacgttaccgtaaacgtaacccgtaggtacggtctaacggttcctaaccgtacg

SEQ ID NO: 69677 - DNA, 600 bp, Homo sapiens
  misc_feature: GYAE6OF02FJOSQ.51.76.G10.1.454.CMB.1.raw
  modified_base (195)..(195): a, c, t, g, unknown or other
  misc_feature (195)..(195): n is a, c, g, or t
  modified_base (378)..(378): a, c, t, g, unknown or other
  misc_feature (378)..(378): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaaacctggccaggcctcccgaggcctcctcattctatgatgcactccacgaagggcccaatgactactcccagcctaggttcaggtggctaggtgggtactggggacaggagtttcacttcncaccactcagcgacgcctgcgtacgtcgtaggtaacgttagttttcgactttaaattttattacgtgtactagtactaagttaataaacttaacgtcggttaccttaccgttaccgttacgttttacgggaccgtacggggtacctaacggtacgtagggtaacgtaacgtaacccgtaaacgtaaccgttaggtacggtaccgtacggacctaaccctacg

SEQ ID NO: 69678 - DNA, 605 bp, Homo sapiens
  misc_feature: GYAE6OF02FU840.51.76.G10.1.454.CMB.1.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (297)..(297): a, c, t, g, unknown or other
  misc_feature (297)..(297): n is a, c, g, or t
  modified_base (474)..(474): a, c, t, g, unknown or other
  misc_feature (474)..(474): n is a, c, g, or t
  modified_base (575)..(575): a, c, t, g, unknown or other
  misc_feature (575)..(575): n is a, c, g, or t
  modified_base (595)..(595): a, c, t, g, unknown or other
  misc_feature (595)..(595): n is a, c, g, or t
tcagcgatcgtatacacgaccggtgctcgatttagtcactcatacagggggaggaactgctcagttaggacccagacggaaccatggaacgccccagcgcagcttctcttcctcctgcttactctggctccagactaccactggagaagtagtgactgaccgctagtcctccgagccaccctgtctgtgtcctcgagggaacncgccaccctgtctgcacggccngtcagntgtacgnagcgtagtagccgtggtaccagacagtaaccgtgaccgagtcctaccgagtctccgtanactctagtcgtagtcgtaccacttcccgaaggtacgggcctagtacgacttacgaccccaggtcccgttaggttccgaggcgtaccgtaggtccgggttacagggacctaggtacgtttacaccggttctaaccgctacgtacgacgctacgcctagccgtatccgtagtaacgttnttacgacgtttaacttacgttactagtactacgtactagtagtaacgtaacgtcgtaccttacgttacgttgttaccgcgtacggctagcgttagacgtanacgtaagcgtcgtcgtacgngtacgctacg

SEQ ID NO: 69679 - DNA, 526 bp, Homo sapiens
  misc_feature: GYAE6OF02F8J13.51.76.G10.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacagggggaggaactgctcagttaggacccaggacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctnatctatgatgcatccaacgaacgggccactgatactcccagccaggttcagtggcaggtgggtctgggacagtagttcactctcacatcagcagcctgcagtctagaagtatttgacttaatttattactgtcatctagtataataactcggccttacgtactactttcggaccgtacgggacaaggtcgtaggagtaacgtacgaaacgtaacgtcggtaggtctacggacctacgtacg

SEQ ID NO: 69680 - DNA, 872 bp, Homo sapiens
  misc_feature: GYAE6OF02JD17B.51.76.G10.1.454.CMB.1.raw
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctacctctggctcccagataccactggagaagtagtgatgacgnagtcctccagccaccctgtctgtgtctccgaaggggaaancgaccctacccgtcctccgtcgcgacgggccagtccaagtagtgtagcgagcgtactagccgttggtaccagcaacgtaacctggaccacggtcctacccgaggtccttccctatacttacctaagtcgtagtccgtactaacctaccccgaaacgggtaaccggggtcccctaactacggtaaactttacccgaacccccgaaggtaccccgttaacggtttcccgaaagggttcgggtaacgttcggggtacggggttcggtacgggaacgtaaggtaccgttacgtacccgtttccgtacccactacgtaaccgacgtaccgaacggtcccttggtccgtacggttacccggttaaaggtaaacgtttaccgttttaacggtaacccttttaaagtttttaaccgttacgtttacggttaccggtaacggttaacgttaaaccgggtttaaatttaaaaccggttaacccggttacgggttaacccccgttttaaccgggtttacccgtttaaacccgggtttttaccggggaacccgggttaaccggggtaacccccgttaagggttaacccgggttaacggtaacgttaaaccggttaaacccggtaaaccgggttaacgtttaccgggtacggtacccgttaccgtacccgtacccgttaacccgg

SEQ ID NO: 69681 - DNA, 652 bp, Homo sapiens
  misc_feature: GYAE6OF02IERHZ.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgcccacccttctcctgccgagggccagtcagtagtgttagcagcgtacttagccttaggtaccagcaacgaacctggaccacggcctcccgaggtcctcctacgtattcctagtagtactcggactacgtccgaacggacgggtcctagtacgtaactaccgtcccgacgtccgtaggttccgaggtcgacgtggtcgggtctaggggactacggtcgttccacttcgtacctaccgatccgagccgtacgtaccgtgaccgtgtctaaggttaagttacttttgactttaagttttactacgttgtacagttactaaaggttaccttaaagttaccggtacgttcccttacggttaaccttcggtttaccgggacgtacgggtacgtacggtcgttaggaacgtaaccgtaaccgtaaacgtacggttcggacggtcctacgtccacgtttaccg

SEQ ID NO: 69682 - DNA, 713 bp, Homo sapiens
  misc_feature: GYAE6OF02H41M6.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgtacttagcctggtaccagcaagaaccgtggccaggcctccgagctcactcactctatgatcgcactaccgaacgaacggcccagtacgacttaccgtacccgacgtaccgtaggttacgtaggtcggtacgtagggttcggggtaccgtaggggtaaccaaggttacggttcccaacctttaccgtaccgtaacccgtacgtaccgaacgtaccgaccgtccgtacgaccgtacgttacgtaagttaaaggtttacttttacggtactttaaagttttacttacgttacgtacgtacgttaacgtaagtttaaacgttaacgttaacggttaccgttacccgttaccgttaaccgtttaccgggttttaccggacccgggtaacgggaacctacgggtaccggttacgggtaaacgttaaccgtaaccggtaaacggttacgtacggttaccggtacttacccggaacttacccg

SEQ ID NO: 69683 - DNA, 651 bp, Homo sapiens
  misc_feature: GYAE6OF02GF8O2.51.76.G10.1.454.CMB.1.raw
  modified_base (198)..(198): a, c, t, g, unknown or other
  misc_feature (198)..(198): n is a, c, g, or t
  modified_base (491)..(491): a, c, t, g, unknown or other
  misc_feature (491)..(491): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctccgaaggggaaancgcccaccctctcctgccgagggccagtcagagtgtagcagcgtacttagcctggtaccagacagaaacctggaccaggcctccgaggcctcctcgactctatgatcgactactaccgaacgaacgggtccctaagtacgtaactaccgtacccacgtccgttaggttacctaagggtgaccgtagggtcgggttacgtacggggaactacggtacgttacctacgttaccctaacgaacctacgtaccgacgacctacggtccgttgaccgtaagttccgtaagtaacgttnttttaacggacttttaaacgtttataccgttgtacgagtactaagttaactaacgttacgtacgttaccttaacgtacttacggttacgaccgtacggacctaggcgtaaggtacaacgtaacgaaccgtactcggtacgtaccgtacgtacgaccttcg

SEQ ID NO: 69684 - DNA, 631 bp, Homo sapiens
  misc_feature: GYAE6OF02I2NEH.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccacctctcctgcagggccagtcagagtgttagcagcgacttagcctggtaccagcagaaacctggccaggcctcccaggctcctcatctatgatgcatccaacgagggtccacgtagactacgtcccaaggccctaggttaccaggttcggctagggtcggggtctaggggaccaaggtacgtttaccaaccttcctaccacctacttaccgaagccagtccctgacctagtactagtaagttaacgttttgacctttaagttttacttacgttcgtacgtacgtactaagtaagttaaacttaacgttcggtaccttacccgtacttaccgttttaggaccggtacgggtaaccgtaaggtccggtaggtaacgtaacgttaaccgtaaaccgtaacggttacggtacggtactcggtacacccgttacg

SEQ ID NO: 69685 - DNA, 628 bp, Homo sapiens
  misc_feature: GYAE6OF02GRKVO.51.76.G10.1.454.CMB.1.raw
  modified_base (197)..(197): a, c, t, g, unknown or other
  misc_feature (197)..(197): n is a, c, g, or t
  modified_base (332)..(332): a, c, t, g, unknown or other
  misc_feature (332)..(332): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgcccaccctctcctgcacgggccagtcagagtgttagcagcgacttagcctggtaccagcaagaaccgtggccaggcctacccaggtcctcctcactctatgatcgcactccaacgacggccacgtgactacnccagcctaggtcagtgcgaggtcgggtctgggacagtactcacgtctacacctactacacgactacgccgtagcgtacgtcgtagtaacgttagtttacgactttaattttacgttacgtacgtttacgacgtactaagttaacttaaacgtaacgttaccggtacccgtttaaccgttaaccgtttaacggttttccgggaaccgttacggggtaacccgtaacggtcggtacggaacgtaacggttaacgaaaccggtaacgttacggtacggtacgtaccggacctacctacg

SEQ ID NO: 69686 - DNA, 665 bp, Homo sapiens
  misc_feature: GYAE6OF02IBYK0.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttagcagcgacttagcctggtaccagcaagaaacctggccaggctcccgaggctcctcatcctaatgtatgcatccgacaacgggcctactgactacgtccagcctaggttccaggtggactaggtcgggtctacggggactaaggtagtttccacgttaccttccgaacctagtacgtacgaccacgtaccctacgaccgtacgtacgtaggtaaagttaacgttttacggtaacttaaacgttttaacgtttaccgttagtaccgtagttaccgtaacggttaataaacgttaaacgtcggtacccttaccggttaacttaaccgttttacggacccggtacgggtaaaccgtaacggtccggttaacggtacggtaaccgttaacgtaaaccggtaacgttacggttacggtcgtaccgtaccgtaaccgttaccg

SEQ ID NO: 69687 - DNA, 616 bp, Homo sapiens
  misc_feature: GYAE6OF02H57C5.51.76.G10.1.454.CMB.1.raw
  modified_base (260)..(260): a, c, t, g, unknown or other
  misc_feature (260)..(260): n is a, c, g, or t
  modified_base (276)..(276): a, c, t, g, unknown or other
  misc_feature (276)..(276): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (600)..(600): a, c, t, g, unknown or other
  misc_feature (600)..(600): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccacgtggaagaagtagtgatgacgcagtctccagcccacctgtctgtgtctaccgaaggggaaagacgcccacctctcctgcgagggcagtcagagtagttagcgagcgattagccgtaggaccngacaagaacctggacncgcctccgaggctcctnactactagtnacgtncacgtaccaacgacggtcccagtnaacttccaccgaagtcctaggttccgaggtacggngacggttggtcgtaggacgaagtcgtacacgtcctacacctagaccagtacnggtaccctgactaggtactaggaactttattacgtacttaactttaattactcagtagaacttaagtaataaacgttaactcgtacctttaccgaagtttccttagggacccgaacgggtacctaaggtccggtaagtaacgtaacctaaaccggtaaagaacctttgggacggtttaccncgaacccgtacctaag

SEQ ID NO: 69688 - DNA, 692 bp, Homo sapiens
  misc_feature: GYAE6OF02ITSPE.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaanacgcccaccctctccctgcagggccagtcagagtgttagcagcgacttagcctaggtaccagacaacgaaaccgtggaccaaggcctccccgaggcctcctcatctatgatcgacactaccaacgaacgggacctacgtagactactccccgaggcctaggtttcaggttcggacgtagggttcgggtcgtacgggaacaggtacgttcaaccgtcctaccgaaccctactaccgaacgccgaacgtccctacgacgtacgtacgttaggtaacgtttagttttacgaactttaattttaacttacgttacgtacctagtacctaagttaattaaacttaaccgttaccggtaccctttaccggttaaccgtttaaccggttttacgggacccgtaacgggggtaacctaacgggtacggttaagggaacgtaacgtaaaccggtaaaaccgtaacggttcgggttacggtaccgtacggtacccgtacttaaccg

SEQ ID NO: 69689 - DNA, 618 bp, Homo sapiens
  misc_feature: GYAE6OF02H3931.51.76.G10.1.454.CMB.1.raw
  modified_base (198)..(198): a, c, t, g, unknown or other
  misc_feature (198)..(198): n is a, c, g, or t
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagcgatcgtatacacgaccggtgctcgatttagtcactcatacaggggaggaactgctcagttaggacccagacggaaccatggaagcccagcgcagcttctcttcctctgctactctcggctcccagactaccactggagaagtagtcgatgacgcagtctccacgtccacctgtcctgtgtctcgagggtaaancgccacctcgcctgaccacgggccagtccgaaggngttcgttacgcagacgtattacgccgtacggtacacggaccaaggtaaccgtcggaccgaggtccctaccgaggtcctctacagtcctagngtactcgcactccgagacggcactgacttacnccgatcgcgttcgatcgganacggttcggtcagggactaggtacgttcacgttcgtaccgatacgtcgacgcgtactcgacgactacggtacacggtaacgtagtttacgtacttaattacgttacgtagtacgtagacgtagttacgtaacgttacgtccgttactaccgtacgttacgtttacgaccgtacggtacgtacggtacgtacggtacgtacgtaacctaacggtacgtacgaccgtacgtcgacctacgtacg

SEQ ID NO: 69690 - DNA, 631 bp, Homo sapiens
  misc_feature: GYAE6OF02G9K57.51.76.G10.1.454.CMB.1.raw
  modified_base (280)..(280): a, c, t, g, unknown or other
  misc_feature (280)..(280): n is a, c, g, or t
  modified_base (351)..(351): a, c, t, g, unknown or other
  misc_feature (351)..(351): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagagcccacctctcctgcgagggccagtcaggtagtgttagcagcgtacttagcctggtaccagcagaacctggcaggctcccngctcctcatctatgatgctatccacgacgggaccacgtgactactcccagccgaggttacaggtcggacgnggtcgggtcgtgggacaggtagttcacgtcctacacctactcagcgactccgtgacgtacgtcgtaagtaagttgtttagtactttaacttttaagttacttgtacaacgtactaacggttaaataaacgttacgtaccggttacccttaacccgttaacgtttaccgttttacgggacccggtacggggaacctaacgggtcgttagggaacgtaacgttaaaccggtaaacgtaacggtacgggttacgggtacgtacggtacgtacccgtttaacgg

SEQ ID NO: 69691 - DNA, 731 bp, Homo sapiens
  misc_feature: GYAE6OF02HERTW.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctcagccaccctgtctgtgtctccgaaggggaaagcgccaccctctccgtgcgagggccagtcagagtgttagcagcgacttagcctaggtaccagcaacgaacgtcggccaggcctccaggcctcctcatctagtgatcgactactaccaacgaacgggccaacgtagactaccgtacccgaacgtaccgtacggttaccaagggtttcggaccggtaagggttcggggttaaccgtacgggggtaactaaggttaccgtttacctacccgtcttaacccgaacctactaccggtaacgccgtaacgtcccgtacgtacgacggttaccgtaaggtaacgtttaacgttttacgtaacttttaaacgttttaacgtttaccgttacgtaccgtaagtaaccgttaacggtttaaaacttaacggttaaaccgttcggttacccgtttaaccgttaaccgttaccgtttacggggaacccggttacggggaacccgtaacggtcggttacggaacgtaacgtaaccgtaacggtacggtacggttaggaccgtacgtacctacgttaccg

SEQ ID NO: 69692 - DNA, 790 bp, Homo sapiens
  misc_feature: GYAE6OF02J075J.51.76.G10.1.454.CMB.1.raw
  modified_base (197)..(197): a, c, t, g, unknown or other
  misc_feature (197)..(197): n is a, c, g, or t
  modified_base (365)..(365): a, c, t, g, unknown or other
  misc_feature (365)..(365): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaancgccaccctctcctgccgacgggccagtcaggtagttgttacgcaggacgtacgttacgccgttgggtaaccaggacaacggaaaccgtgggacctacgggcctaccccgaggtcctacccatacttctagtggatcgactaccgtccaacggtaacgggccaggtanacgttacctacccgagaccccgtagggtttaccaggtttcgggaccgttacgggggtttagggtcccggtaaggggaacctacgggttacgttttacccacgttcccgtaccctaactaacgtacgaccgggtactacccggtccgttacggaccgttagtaccggttaaggttaaacgtttagttttaccgttactttaaacttttaccgttacgttacggttacctaaggtaacttaaacggttaaacttaaaccggttaccgttaaccgggttacccgtttaaccggttacccttagggttttacccgggaccggtaacgggttaaccgtacgggttaaccggttaacggtaacggtaaccgttaaccggtaaaccggttcgttaaccgggacggttccgtacgtaccgtacccgttaaccg

SEQ ID NO: 69693 - DNA, 595 bp, Homo sapiens
  misc_feature: GYAE6OF02F4UFA.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccaggcaagaaacctggaccaggcctcccgaggcctcctacatctatgatgacatccagaacggccactgactactcccagccaaggttcaggtcggacgtaggtgggtctagggaacagtacgttcaccgttctacaccgtatccaagacgacgacctgactacgtcgtagtaacgttagtttacgtacttaattttaatacgttagtacgtaagtactaagtaattaaactacgtcggtacccttacgtaacgttacgtttacggaccgtacgggtaaccaaggtcgtaggaacgtaacgttaccgaaacgtacgttaggtacggtactacgtacctaccgtacg

SEQ ID NO: 69694 - DNA, 760 bp, Homo sapiens
  misc_feature: GYAE6OF02HUDAP.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagcccaccctctcctgcgagggccagtcagagtgttagcagcgattagcctaggtaccagcaagaaacctggaccaggcctacccgaggcctcctcactctatgatgctatccacgtaacgggccaactgtaactacgtacccgagcccgtaggtttccaagggtcggcgtagggttcggggtacgttacgggggactaggttaaacggtttccaacccggtttccttacccgaacccgtacttaccgaacgacccgtacggtccctaggacctaacgggttaccgtaaggttaaagttaacgttttacgtaactttaattttaacgtttaacgttacgtaaccgtaacggtacgtaaacgtttaacgttaaaaccgttaaccgtaccggttacccgtttaacccggttaaccgtttaaccgggttttacggaacccgggtaaccggggttaacccgtaacgggttacccggtaagggttaaaccgtaaccgttaaacccggtaaaaccggttaccggttacggtacgggtaccgttaaccgacccgttaccggttaacccg

SEQ ID NO: 69695 - DNA, 743 bp, Homo sapiens
  misc_feature: GYAE6OF02IW8F0.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcagggccagtcagagtgttagcagcgtacttagcctggtaccagcagaaacctggccaggcctccccgaggcctcctcattctatgatgctatccacgaagggccactgatctacccagccgtaggttcaggtggcctagggtcgggtcgtagggactaggtacgttcctacttccgtaccaccgtactaccgacgaccgaccgtcccggttagcccgtagttaccgtaacggtaaaggtttacgtttttacggaactttaaacgtttttaacgtttaaccgtttagggttaccgaacggttacgttaaacgtttaaacgttaaaacgtttaacccggttaccgggttaccccgttttaaccccggttaaccgttttaacccgtttttaccgggggaaccccggtaacggggggttaaccctaacgggtaccgggttaacgggaacggttaaacccgttaaccggtaaaacccggtaacggtttacggggttaccggtaacccggtaccgtacccggtaccttaacccgg

SEQ ID NO: 69696 - DNA, 719 bp, Homo sapiens
  misc_feature: GYAE6OF02FVE53.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgcccaccctctcctgcacgggccagtcagagtgttagcagcgacttagccgtggtaccagccagaaaccgtggccaggcctcccgaggtcctcctacatacctatgatacggccactccaacgaacgggcctaacgtagactacgtcccagccgtaaggttcagtggacgtaggtcgggtcgtaggggactaagggtacgttaccgacttccgtacctaaccgtacgtaacgacgccgtaacggcccgttcggacgtacggttacgtaacggttaacgttaacgttttacggaaccttttaaacttttaactttaccggtttaggttaccgtaacggtaccttaaaggtttaaacttaaacgttaaccggtaccggttacccgttaacccgtttaaacgttaccggtttttacgggacccggttaaccggggaaaccctaacgggtcggttaacggtaacgtaaccgttaaaccggaaaccggttacgttcgggtaccggtacgtcgtacccgaaccgttacg

SEQ ID NO: 69697 - DNA, 783 bp, Homo sapiens
  misc_feature: GYAE6OF02GR0U4.51.76.G10.1.454.CMB.1.raw
  modified_base (323)..(323): a, c, t, g, unknown or other
  misc_feature (323)..(323): n is a, c, g, or t
  modified_base (330)..(330): a, c, t, g, unknown or other
  misc_feature (330)..(330): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagacgcccaccctctcctgcacgggccagtcagagtgttagcagcgtacttgccgtagtaccagcaagaacctggccaggcctaccgaggctcctcatctatgatgcactaccacgacggcctacgngactacncccagtccgtaggtccgaggtcggacgtagggttcgggtaccgtaggggaacctaagggttacctttaccgaccttcccgtaccgaacccgtaacgttaccgacgtacccgtaaccgtcccgttacgaccgttaacgttaccggttaaggttaacgttttaacgtttttaggttaacccgttttaaaacgtttttaacgttttaccgtttacggttaaccgtaacggttaccgttaaaggtttaaacgtttaaacggtttaaccgttaccggggttacccctttaacccggtttaaccgtttaaccggttttaccggggacccggttaaccggggggtaaacccttaccggggttaacggttaaccgggtaacccgtaaacggttaacccggtaaacggttaacccggtttgggtaaccggttcccggtaaccggttaccccaacggtttccg

SEQ ID NO: 69698 - DNA, 817 bp, Homo sapiens
  misc_feature: GYAE6OF02IIHDS.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctntcctgcagggccagtcagagtgttagcagcgacttacgcctggtaccagcagaacctggaccaggcctccgagcctcctcatctatgatgctatccanacgggccactgactcnccagcctaggttcacgttcggcctaggtcgggtcgtggggactaggtacgttcgaccttcgtaacctaccctacgttaccgacgtacccgaacgggtacccttacggaccgtaacgggttaccgtaacgggttaaacgtttaaacggttttttacggtaaacccgtttaaacgttttttttaaaccgtttaaaccgtttacgttaccgttaaaccgggtaccgtttaaaacgtttaaacgggttttaaaaaccttaaacgggttttaccccggttaacccccgtttttaaaccgggttacccggttttaaacccgggtttttttaaccccgggggcccggtttaaaccgggggggtaacccgttaaacgggtaaccccggttaacggggttaaaccgggtaaaccgtttaacccgggaaaaaacccggtttacggttaacccgggttttacccgggtaccggtttaaccgtaccccccgtaacccgttttaaacccgg

SEQ ID NO: 69699 - DNA, 633 bp, Homo sapiens
  misc_feature: GYAE6OF02J0AEH.51.76.G10.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (289)..(289): a, c, t, g, unknown or other
  misc_feature (289)..(289): n is a, c, g, or t
  modified_base (337)..(337): a, c, t, g, unknown or other
  misc_feature (337)..(337): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (453)..(453): a, c, t, g, unknown or other
  misc_feature (453)..(453): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccacctggtctgtgtctaccgaggggaaacngcccaccctntccgtgcagggccagtcagtgtgtancagcgtacttagcctggtaccagcagaacctggccaggcctcccgaggcctccnctactcctatagatcgctactaccgacgacggtccacgtagacttacncccgagaccgtaggttcaaggtcgacgtaggtcgggtacgtaggactaggtaacgtttccacgttctaccctaccgatacgacgtacgacgtccngactacggtntacgtaagttntttacgagttatttacgtactcggtacagtacgttattaaacgtaacttaacgtccgttaacccgttacgttaacgttaccggtttcggaacccggacgggtaccgtaacggtcgtaaccggtagtaacccgttaaccgtaacgtacggtcggtaccggtacctagaccttacccttcgg

SEQ ID NO: 69700 - DNA, 651 bp, Homo sapiens
  misc_feature: GYAE6OF02IAZNZ.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccacctgtctgtcgtctccgaggggaaancgccacctctctgcagggccagtcagagtgttagcagcgacttcgctggtaccagcaacgaaaccgtggaccaggcctcccgaggcctcctcatcctatgtactcgcactaccgacgaacgggccacgtacgacttacctacccgagtccgtaaggtttccaggtcgggcgtaagggttcgggtacgtacggggactaggtaccgtttccgaccgttactccgaaacctacgtaccgtaacgaccgacgtaccgttacgacgtacgttacgtaggtaaacgtttctttacggactttaaatttcgttacgtagtaccgtagtacttaaagttaactaagtaccgtaccggtaccttacgtaacgttcgtttacgggacggtacgggtaacctaggtcggtaaggaacgtattaaaccgaacggtacgttgggacgtcgtacgtaccgtattaccg

SEQ ID NO: 69701 - DNA, 658 bp, Homo sapiens
  misc_feature: GYAE6OF02HYTPA.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaagggaancgccaccctctcctgcgagggcctagtcagtagtgttacgacgagcgtacttacgccgtaggtaccagcaacgaaccgtggaccaggcctcccgaggtcctcctacataccgtatgaagtcgactacgtaccgaacgtaacgggccaacgtagtactacacccgagtcctaggttcaggttcggacgtaggttcggtcgaggactagtacgttccaacgtcctacacctacgtacacgtacacgcgtacgactacgttacctaggtaagtttacgtttacgtaactttaaacgttttattacgtagtacgaacgttacgtaagttaacttaaacgtaccgttccggtccctttaaccgtactttaacggtttacggaccgttacgggaacctaagggtccgtaaggacgtaacgtaaccgtaaacgtacgttacggtaccgtacgtactaccgtacgtacg

SEQ ID NO: 69702 - DNA, 712 bp, Homo sapiens
  misc_feature: GYAE6OF02JPXTL.51.76.G10.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
tcagcgatcgtatacacgaccggtgctcgatttagtcactcatacaggggaggaacgtgctcagttaggacccagacggaaccatggaagccccagcgcagcttctcttcctcctgctactctggctcccagactaccactggagaagtagtgatgacgcagtcctccagccaccctgtctgtgtctccgagggaaancgccaccctcncctagcgaggccagtcagagtgttacgcagccgacttagcccttaggtaccagcacgaaacctggacccaggcctcccgagtcctccctagacttccatcgatgctactccaagaccggtccaactagactaccgtcccagtcccgaaggttcgaaggttacgggcctaaggggttcggactcggggtaaacctggtaaacgttcccaacgttcgtaacccaaccgtaactccgtacggaccgtaaccgtccgttacggtacgtaacggttccggtaacgtaaccggtttagttttaccgttaaacttaacggttttaactttaaccgttaggtaacccttaggaaccctttaaggttaaaccttaaacgttaaaccggttccgtaacccgtttacccggttacttaaccggttttaccgaccgtaacgggtaccctaaggtccgttaggaacttaacgaaccgttaataacggtcgtaacggtcgtaacgtcgtaccgttac

SEQ ID NO: 69703 - DNA, 630 bp, Homo sapiens
  misc_feature: GYAE6OF02GBT1A.51.76.G10.1.454.CMB.1.raw
  modified_base (174)..(174): a, c, t, g, unknown or other
  misc_feature (174)..(174): n is a, c, g, or t
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
  modified_base (431)..(431): a, c, t, g, unknown or other
  misc_feature (431)..(431): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtcctccagcccnccctgtactgtgtctccgaggggaaancgccaccctntccngcngggccagtcagngtgtacgcagcgacttagcctggtaccngctaagaaccgtggaccaggcctcccaggtcctcccgtcaacgttctagtggactgcctaactaccgaacgaacggcccagttacgaactaccgtcccgaacgtccgtaaggttcaggtcggccgtaggttggtcgtagggactagtacgttacacgtctacacctatcgacncgagtccgtcgacgtacgtctagtagtatttagacttaacttagttacttgtacgagtacgagttaactaacgtacgtaccgtaccttccgttacttaccgtttacggtaccgtacggggtaccaacggttccggtaaggtacgtaaccgtaacgaaacggtaccgttacggtacggtcctacggtaccttaacggtcc

SEQ ID NO: 69704 - DNA, 581 bp, Homo sapiens
  misc_feature: GYAE6OF02GE5X2.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccgccctctcctgcagggccagtcagagtgttagcagcgacttagcctggtaccagcaagaacctggccaggcctcccgagcctcctcatctatgatgcatccaacgagggccatgatactccagccaggttcagtggcagtggtctgggacagtagttcacttcacacctatcagcgagtcctgactagtctagtaattagtttagacttaatttacttactcgtactagtactaagtaattaacgttaacgtcgtaccttaccgtaccgttacgttttacggaccgtacggggtaacctaacggtcggttaacggtaacgtaagttaaccgtaaaaccggtaacgttacgggtacggtaccgtacgtaccgtaccgtaacg

SEQ ID NO: 69705 - DNA, 927 bp, Homo sapiens
  misc_feature: GYAE6OF02FOFXS.51.76.G10.1.454.CMB.1.raw
tcagcgatcgtatacacgaccggtgctcgattttagtcactcatactagggggtagggaactgctccagttaggacccagaacggaaccgagtggtaacgcccctaggcgcagcttctccttcctacctgacgtacgtctcggcctccctaggattaccgacttggaagaacgttaggtttcgagttggaccgtctaaggtccgttccacgacctaccctgtcgttggtcgtcgtcccgtaagggggaaaacgacgtcccgtacccggtccgtcccgttcggaccgaacggggtcccctagggtacctaccggtaggttacgtaacggtcctacggtacgtaaccgttacgtacccgttcggggttacccaacgggtacctaaacggtaaaaccccgttcgggacccgagggtaccccttacccgtacgggtcccttacccgttacgaacgtaccgttacgttcggtaactccggacctaccgtacccggaacgaacggggtcctaacgtggtaacgtaccgtaccctaagtaccgtaggttcgagtggactaaggggttggttaacgtagggaacttaggtaggttccgtaaccgttccgtacgaacccgtacgttacgacgtaccctaacgtcccgtacggaaccgttaaggtacccgtttaacggaaacgtttaaggttttaacccgaaccgttttaaactttttaaccgttttaccttaacggtaaccttaaggtacccgttaaggtttaaccgtaaacgtaaccggtacggttacccgtaaccggttaaaccgttaccggtttacggaacccgggttaacgggtaaccgttaacggtaccgttaacgggaaacgttaacgtaaccgtaaaacgttaccggttaagtaccgggtacctaacggtaacccgttacgttaaccgg

SEQ ID NO: 69706 - DNA, 662 bp, Homo sapiens
  misc_feature: GYAE6OF02IMTAI.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgagggaaancgccaccctctcctgcagggccagtcagagtgttagctagcgtacttagccttggtaccagacacgaacctggaccaggcctccgaggcctccacatctatgtactgctactcccgaagtaacgggccctacgtcgtactacctcccgaagcccgtaggttccgaggtcggacgtacgggttcgggtaccgaggggactaaggtaccggtttccaccgttccgtacccaaccgtattaccgacgtactaccggtccgtacgaccgttacgtcgtacgtaagtttacttttcgtaacctttaaatttttacgttattacggtctaagtactaacgttaacttaacgttaccgtcggttacccttacgttaccgttacgtttcgggaccgtacgggtaacctaggtccggtaggtaagaaccgttaaccgaaacgtccgttaggaccgtacgtcacgtacccttacg

SEQ ID NO: 69707 - DNA, 580 bp, Homo sapiens
  misc_feature: GYAE6OF02F2367.51.76.G10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagngtgttagcagcgacttagcctggtaccagcagaacctggccaggctcccaggctcctnatctatgatgcatccacgaacgggccatgactactcccgagcctaggttcaggtggcaggtcgggtctaggggacaggtacgttccacttcctacacctactcgacgccgacgtcccgtagcgtacgtacgtagtagttagttttagacttaattttacttacgttgtactagtactagttactaacttacgttcgtaccttccgttaacgttcgtttacggaccgtacgggtaccgtacggtcgtagggtacgtacgttaacgaacgtacgtaggtacgtacgtcgtaccacctacg

SEQ ID NO: 69708 - DNA, 564 bp, Homo sapiens
  misc_feature: GYAE6OF02HGM2A.51.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagngtgttagcagcgacttagcctggtaccagcagaaacctggccaggcctcccgaggcctcctacatctatgatgcatccagaacgggccacgtgatactcccgagcctaggttcaggtcggcaggtcgggtctgggacaggtagttcactctcgacctatccagctacgcctagctaggtctaggaaattntttcgaacttaatttnttactgtacagtactagttaataaactacgtcgtcccttacgtaccttacgtttcgggaccgtacgggacctaacggcgtaggaactaacgtaaccgtaaacggtacgtggtacggtctacgtccaccgttc

SEQ ID NO: 69709 - DNA, 682 bp, Homo sapiens
  misc_feature: GYAE6OF02I5WVW.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtcctccagccaccctgtctgtgtctcgaggggaaanagccaccctctcctgcagggccaggtcagagttgttagcagcgacttagcctggtaccagcagaaaccgtggccaggcctcccgaggcctcctacagttactagtggatcgaccatacccgaaccgaacggggccctaacgtcgaacttaacaccccgagacccgtggtttacccaggttcgggactaggggtttcggggtccgtagggaactacgggtaactttccgaaccttccctaccgaaccctaagtaccacggtacccgaacggtcccgttaggaccgtaggtaccgttaaggaacgttttaagttttacgaactttaaagtttttacttacgttcggtactacgtacgttaactttaagtaaacgtttaacgtacggtacccttaccggttacttacggtttcggaccggtacgggactacgtacggtagaacgtaacgtaccgaaaggtacgtacggtcggcctagtaccactacg

SEQ ID NO: 69710 - DNA, 590 bp, Homo sapiens
  misc_feature: GYAE6OF02I1JVY.51.76.G10.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (364)..(364): a, c, t, g, unknown or other
  misc_feature (364)..(364): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctacaggggaanagccaccctctcctgcagggccagtcagagtgttagcagcgacttagcctggtaccngacagaacctggccaggcctccaggctcctnatctangatgcactcacgaacggccactgactactccaagtccaggttcagtcggctaggtggtctgggacagtagttccntccgtacacctagtacacgcgtaagccttggactacgtcgttacggtaaagttactttttacggactttaaagttttaccttaacgttagtccgtaagtccttaaaggttactaaacgttaacgtcggtacccctttacggtaacttaacgtttacggaccgttacgggaactaacggtctaagggacaacgtaccgaaagtacgtgtacggcgtacgctaactcg

SEQ ID NO: 69711 - DNA, 640 bp, Homo sapiens
  misc_feature: GYAE6OF02H65DG.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtcctccagccaccctgtctgtgtctcgagggaagngccacctctcctgcgaggccagtcagagtgtagcgagcgacttagcctggtaccagacgaacgtaaacctggaccgaggcctacccgaggtctcctcaatccgtatgtatcgctactaccaacgaacgggccacgtgtaactactacccaggcccgtaggttacgtaggtcggacgtagggttcgggtcgtagggacgtaggtcgtttaccactccgtaccaccgtagtaccgtacgctacgtcctacggacgtacggttacgttaagtaacgttttaagtttacgtaactttaaagttttacttacgtcggtaactagtacttaaacgttataacttaacggtcgtacccgttctaccgttacggtttcggacgtacgggtacctaaggtccgtaaggtacgtaataacccgaacgtacgtggtacggtccacggtaccatacg

SEQ ID NO: 69712 - DNA, 589 bp, Homo sapiens
  misc_feature: GYAE6OF02FUAVL.51.76.G10.1.454.CMB.1.raw
  modified_base (196)..(196): a, c, t, g, unknown or other
  misc_feature (196)..(196): n is a, c, g, or t
  modified_base (377)..(377): a, c, t, g, unknown or other
  misc_feature (377)..(377): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctctcctgcagggccagtcagagtgttagcagcgacttagcctggtaccagcagaaacctggccaggctcccgaggctcctcactctatgatgcactccagaacgggccactcgatacgtcccagcctaggttcagtcggctaggtgggtctagggactaggacgttccacttcncgactactcgaagcgacgctcgctagtcgtagtagttagttttcgacttaattttacttacgttgtactagtactaagttagttaacttaacgtcgttacccgttaccgttacgttaccgttttacggacccgtaggggaacccgtaacggttcgtaggacgtaacttaaccggaaacgtacgttggtaccggactacgtacacccgttacg

SEQ ID NO: 69713 - DNA, 759 bp, Homo sapiens
  misc_feature: GYAE6OF02GO36O.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaangccaccctctcctgcagggccagtcagagtgttagcagcgacttagcctggtaccagcaagaacctggaccaggcctcccgaggcctcctcactctagtcgatgcctactcccaacggaacgggccctacgttagaacttacctaccccgaagtcccgttaacggtttcgacggttcgggacgtaggggtcgggttaccgtgggggaactaggtaacgtttacccgtaccgttacccgtacctaaccgtacgtaccgaacgtaccgtacggtcccctaggtacccttaggtaccgtttaaggttaacgggtttattttacggttaaccgttttaaagtttttaacgtttaccgtttaggttaccgtaacggttacgttaaacgtttaaacttaaacgtttaaccggttccggttacccgttaaccggtttaaccttaaccgggttttaccgggacccggttaaggggtacccctaaagggtccggttaacgggtaacgtaaacgtaaccggtaaaaccggtacggttacggtacggttacccttacggacccttacgttaccgg

SEQ ID NO: 69714 - DNA, 738 bp, Homo sapiens
  misc_feature: GYAE6OF02JEQLY.51.76.G10.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccagccaccctgtcctgtntctccgaggggaanacgcccaccctctcctgcagggccagtcagtagtgttacgcagccgtactttacgcccttagggtacccaggaccaacggaaaacccgttcggggacccaacggggtccctaccccgaagggtcccctaccgtacacttctaagtcgaactcgacctacgtacccgaacggacgggtacccagtacgtactaccgtcccgagtacccgtaggtttcgacggttcggcgtagggtcgggtacgtgggaactagtacgttcacgtcctaccacgatacacgcacgtccgtgactagttccgaaggtaactttacgttttagtaaccttttaacgttttacgtaccgttagtaccgtacgttaacgttaaacgttaaacgttaaccttaaccggttcccggttaaccctttacccggtaacttttaccgggtttaccgggacccgtacggggtaaccgtacggtaccgggtaaggtaaaccgttaccggtaaaccgaaaccggtttcggttacggtaccggtacctacggtacctaccggttacg

SEQ ID NO: 69715 - DNA, 651 bp, Homo sapiens
  misc_feature: GYAE6OF02HOYFY.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgcccaccctctcctgcgacgggcccagtcaggagttgttacgcagcgacttacgcctggtaccagcaagaacctggccaggcctcccgaggcctctcatcatcgatcgcatccgaacgacggcctaacgtgacttacctcccgacgtaccgtacggttcgacggtcgggcgtagggtttcgggtcgtaggggaactaggtacgttccaccttctacccaacctagtacaacgcgtacgtccgtcgacgtacgttacgtaacggttaaacgtttgttttacgtaactttaaatttttacgtacgttacgttacctaaggtcttaaagttaacgttaacgtacggttcgtacccgttacgttacttaccggtttcggaccggtacgggtactaacggtcgtacggaactacgtaacgtaaccgtagttcggacgttacgactacccgattaccg

SEQ ID NO: 69716 - DNA, 614 bp, Homo sapiens
  misc_feature: GYAE6OF02FFTD2.51.76.G10.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctggtaccagcagaaaccgtggccaggcctcccgaggcctcctcatctatgatgcatccacgacgggccagtnactactcccgagccgaggttcaggtcggcgtagggtcgggtcgtgggactaggtacgttcacgtcctaccgacctactcgacgtcgaacgtccgtagactacgtctagtaaagtttactttacgactttaaacttttacttacgttgttacagtctaagttaactaaacttaacgttcgtacccttaccgttacgttacgtttaccgggaccgtacgggtaacctaggtcgtaggaacgtaacgtaaccgtaaacggtacgttagggttaccggcgttaccgaccgtacccgtacg

SEQ ID NO: 69717 - DNA, 612 bp, Homo sapiens
  misc_feature: GYAE6OF02H4SP3.51.76.G10.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (375)..(375): a, c, t, g, unknown or other
  misc_feature (375)..(375): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtgtctccgaggggaanacgccaccctcncctgcgagggccagtcagagtgtagctagcgtacttagcctaggtaccagacagaacctggacctaggctacccaggccttccncactctatgactcgacactccaacgtaacgggccagtgtatacgacccagccggtacgttacgacgtcggcgtaggtcggtntacgggacaagggtcttccaacgttcctacactactaccgagctacgcctagtcgtacgtactaagtacttagtttagactttaatttaacttcgtacgtgtaacggtactaagttaactaaacgttaacgttccgtaccttacgtaccgtttcgttacgggtaccgaggtacctaaggtcgtaaggtactacgtaacgtaaacgtccgtaggtcgtacgaccgtacgtacgtaccg

SEQ ID NO: 69718 - DNA, 611 bp, Homo sapiens
  misc_feature: GYAE6OF02F7BR8.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanacgccaccctctcctgcagggccagtcagagtgtagcagcgtactagcctggtaccagcaagaacctggaccaggcctacccgaggcctccctacacttctagtgatcgcactccgaacgacggccacgtcgattacgtacccacgaccgtaggtttccaaggttcggacgtagggttcgggttacgcgggactaaggtcgttaccgacttccgtaacaccctatacgagccacgtccgtatcgtacttagtagtaagttagtttacgtacttaacgttttagttacgtattacgtagtaccgtaattaagtaaacgttacgtccggttacctaccggttacgttacgttttcggaccgtaggaccgagtccgagtacggaactacgaaccgtagtcgtagctcgacgtactacg

SEQ ID NO: 69719 - DNA, 725 bp, Homo sapiens
  misc_feature: GYAE6OF02JJQ0B.51.76.G10.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
tcagcgatcgtatacacgaccggtgctcgatttagtcactcatacagggggaggaactgctcagttaggaccagacggaaccatggaagccccagcgcagcttctcttcctcctgctactctggctcccagataccactggagaagtagtgatgacgcagtctccagccaccctgtctgtgtctccgaggggaanacgccaccgtctcctgccagggccagtcagngtgttagcagcgtaacttgcctaggtaccagcagaaacctggccaggcctcccgaggcctccgtcactcctaagtgactcgacactccgaacgtaaacgggccctaacgtcggaacttaccgacccctaacggacccgtaaggtttcccgaaggtttccgggactaacggggttgggtaccgggtacggtaccgtaacgggttacgtttaaccgtaccggttactaacccgtacccgtaacgtccgtaaaggtcccgtaaacggccctcggtaacgtacggttacgtacggtaacggttagttttacaaccgtttaaatttcgttaacgttcggttactacgtaactaacggttaactaacgttaaacgttccgggtacccttacccggttaacgttaacccgtttgggtaacccggtagggtaaccctagggtaccgtacggtaagtaccgttaacgtaaccgtaacggttcgaacggtcgttagaccgtaccgtacg

SEQ ID NO: 69720 - DNA, 571 bp, Homo sapiens
  misc_feature: GYAE6OF02FV80C.51.76.G10.1.454.CMB.1.raw
  modified_base (197)..(197): a, c, t, g, unknown or other
  misc_feature (197)..(197): n is a, c, g, or t
  modified_base (289)..(289): a, c, t, g, unknown or other
  misc_feature (289)..(289): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcgacgggccagtcagagtgttagcaagcgaacttagcctggtaccagcagaaacctggccaggctcccaggctcctnatctatgatgcatccaacgtacggccacgtgatactcccgagccgacggttcagtgcgtaggtcgggtcgtagggactagaggttccacttctacacactcgacgcacgcctgcgtagtcctagaagtacttttagaccttaagtttactacgtgtacgtagtacgtaagttactaaacgtaacgtcgtaccgttacgttacgtacgtttcgaccgtacggggtactaggtcgtaggtacgaataccgaaagtacgtggtacggtcgtacgaccgtactacg

SEQ ID NO: 69721 - DNA, 779 bp, Homo sapiens
  misc_feature: GYAE6OF02G9P6H.51.76.G10.1.454.CMB.1.raw
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctccagataccactggagaagtagtgatgacgctagtctccagcccaccctgtctgtgtcctccgaagggaagcgccacccctntccngcacgggccaggtcagagtgttagcaggcgtacttagcccgtggtaccgacgacacggtaacctggaccgacgggccttaccccgaaccggtcctaccccgtcctaacgttcctacgttctaaccgttgaccgtaccttaccccgaaccgtaaccggggtacccaaccgttacggtaaccgttaccctacccccgtacgacccccgtaagggtttaccgacggtttaccgggaccgtcggggttacgggttccggttacggggaccgtaacgggttaaccggtttcgaaccctttaccggtttaccaaccgttaccaccgtaacgtaccgaaccgtccgtccgtacgtacgttacgtacgtaagtttacgtttaccgttactttaaagtttctttaacgtcttacgtacgtcttaaccgttaataactaccggttacgtacccgttacccgtaacgtttccgttacggacccgttacggggaaccttaccgggaacgtttacggaagtaaccgttaaccgtaaacggttaacttggtacccgtggtaaccgtaccgtccttaacggg

SEQ ID NO: 69722 - DNA, 643 bp, Homo sapiens
  misc_feature: GYAE6OF02HQRUC.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgtacttaggcctggtaccagcaacgaacctggaccaggcctcccgaggcctccgtcatctatgatgcatccagaacgggccatgactactcccagccgtaggttcaggttcggacgtaggttcgggtacgtgggacaggtacgttcctactcgtacctaccactccgagccgacgcctacgtacgtagtcgtaggtaacgttacgtttgtaaccttaatttttacgttaacgttcgtaccgtaaggtccgtaaagttaacgttaaacttaaaccggttccgtaacccgtttccgttaacctttacggtttcggaccggtacggggtaacccaggtcggtaacggtacgtaacgttaaaccgaaaccggtacgttcggtacgtaccgtacgtacccgtaacctacgg

SEQ ID NO: 69723 - DNA, 711 bp, Homo sapiens
  misc_feature: GYAE6OF02H5MJT.51.76.G10.1.454.CMB.1.raw
  modified_base (200)..(200): a, c, t, g, unknown or other
  misc_feature (200)..(200): n is a, c, g, or t
  modified_base (392)..(392): a, c, t, g, unknown or other
  misc_feature (392)..(392): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccctaccctgtctgtgtctaccgaggggaaanacgcccaccctctccgtgccgagggccagtacaggtagtgttacgcagctacttacgccgtcggtaccagcaacgaaacctcggaccaggtaccctcccgacggtcctcctactatactataggtatcgacctacaccgaacgaacgggcctaacgtagtaactacctcccgaacgtcccgtaaggttaccngggttacggcgtaagggttcggggtacgtacgggacctagtaacgttccgaccttacgtaccacgactacgcgaccgacgtcccgtagtcgtaacgttacgtaaggttaaaggtttactttccggtaattttaatttaaacgttttacgtacgtaccgtaagtactaaaggttaactaaacggttaacggtacccgttaccgttacctacgttaccgttttcgggaccggtacggtaccgtaacggtcggtaacgggtactaacgttaaacccgtaacggttacgttacgggactaccggtaccgccgttaaccgtcgg

SEQ ID NO: 69724 - DNA, 835 bp, Homo sapiens
  misc_feature: GYAE6OF02GRNB1.51.76.G10.1.454.CMB.1.raw
  modified_base (305)..(305): a, c, t, g, unknown or other
  misc_feature (305)..(305): n is a, c, g, or t
tcagcgatcgtatacacgaccggtgctcgatttagtcactcatacaggggaggaactgctcagttaggacccagacggaaccatggaacgccccagcgcagcttctcttcctcctgctactctggcctcccagactaccactggagaagtagtgatgacgcagtcctccacgcccaccctgtctgtcgtccgtacggaaggggaaacaccgccctaccctctccgtggaccgacgggcctagtcgaggtagttagtacgcacggtcgtacgtacgccgtagtaccagacaacgaaccgcggaccncggcctaccgacgtccctcgtactactacgtatcgagtcgaccactacccgtaacggaacccgggtacctacgtacgtaactacccgttacccgaggtaccccggttaaggtttaccggacggggtaccggttacggttacgggggtttaccggggtacggtacggggaaaccgttagggttaccttttacccggtaaccccgttttcctaacccgtaaccctacggtacccgaaccggtaccgtacccggtccgtaggtaccttacggtacgtaacggtttaagtttacgttttagtaaccttttaaagttttacgttacgttcggttaacacggttaaacttaaacggttaacctttaaccggtaaccgtttcccggttaaccctttacgttaaacccgtttccggggttaccgaacccgggttacgggaaccttaccggggtaacggttaacggaaccgtaaacccgttaacggtaaccggttacggttaccggttaccgggcttaaccggtaccgtacccgtttac

SEQ ID NO: 69725 - DNA, 771 bp, Homo sapiens
  misc_feature: GYAE6OF02JHMCB.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccacctgtctgtcgtctccgaaggggaaanacgcccaccctctcctggcacgggccagtcagaggttgtacgcgagcgtacttacgccgttggtaccagacaacgaaacctgggaccaggcctacccgaggtccctcgtacacgttcctatgtactcgacctactaccgaacggtaacgggtacctacgtagtaaccttaccgtaccccgaacggtacccgtacgggttacaaaccggggtttcggaccgttacggggtttcggggtacgttacggggaactaacggtttaccgttcgtacccgtttacacccgtaacctacgttacccggaagcccgtaacgtcccgtacggaccgttaggttacctaaggttaaacgttgttttacgaaacttttaacgtttaaccgttacgttataccgtaagttaccgttaaacgtttaaaggttaaccttaaacggtcccgtttaacccgtttaccggttaacgtttaaccgggtttacgacccggtaacggggtacctacgggttaaccgtaggaaacccgtaataacccgtaaaggtaccgttcggtaggtacccgtagtaccccgtataacgg

SEQ ID NO: 69726 - DNA, 635 bp, Homo sapiens
  misc_feature: GYAE6OF02IX3VH.51.76.G10.1.454.CMB.1.raw
  modified_base (198)..(198): a, c, t, g, unknown or other
  misc_feature (198)..(198): n is a, c, g, or t
  modified_base (351)..(351): a, c, t, g, unknown or other
  misc_feature (351)..(351): n is a, c, g, or t
  modified_base (446)..(446): a, c, t, g, unknown or other
  misc_feature (446)..(446): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtcctccagccaccctgtctgtgtctccgaggggaanagcccaccctctcctgcgagggccagtcagagtgtagcagcgacttagcctggtaccagcagaacctggccaggcctccccgaggtcctcctactactactacgtgtactcggaccactacccgaacggaacgggccaacgttcgactaaccnccccgaagcccgtaggttacaggtacgggctaggggtcgggttcgaggggaactagtaacgttcgaccttcctacgaccctagtccgacgcgacncccgtagcgtaacgtctaaggtagttatttacgacttaagttttattacgtgtaccaagtactaagttacttaaacgtacgtaccgtcctaccgttacttacggttcggacgacgggtacagggtcgtaggtaacgacgttaaccgaaacgttaacggtggttaccggacgaccgtaccaccgttaacg

SEQ ID NO: 69727 - DNA, 559 bp, Homo sapiens
  misc_feature: GYAE6OF02IFTQ6.51.76.G10.1.454.CMB.1.raw
  modified_base (200)..(200): a, c, t, g, unknown or other
  misc_feature (200)..(200): n is a, c, g, or t
  modified_base (408)..(408): a, c, t, g, unknown or other
  misc_feature (408)..(408): n is a, c, g, or t
  modified_base (447)..(447): a, c, t, g, unknown or other
  misc_feature (447)..(447): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaagggggaaancgcccaccctcctcctgcgagggccagtcagtagttgtagcagcgtattgcctaggtacagcaacgaacctggccaggcctcccgaggtcctcctcatcaatgatgcactccaacgaacggccagtgaactctcccgagtccgtagttcgagtggactggtgggtctagggactagtcgttcacgttcacctacactcagctcgtccngacgtgtcgtagtaagtatttgacttaatttatacgttntacagtatagtataagtacgttcgccttacgtactcgttacgacgtacggacctaggtcgtaggtacgactaacgaacgtacgtaggtcgtaccgtacgtaccgaccttacg

SEQ ID NO: 69728 - DNA, 709 bp, Homo sapiens
  misc_feature: GYAE6OF02JOE3J.51.76.G10.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagtcccacctgtctgtgtctccgagggggaaanacgccacccgtctcctcgcagggccacgtcaacgngtgttacgcagcgtacgttacgccttaggtaccagtcacgaaaccgtcggccaggtcctacccgaggtcctccgtcgtactacgtatcgattcgctacgtacccgacgaacgggcctaaccgtacggtaacttaacccgtacccgaacgtacccggtaacggtttcgaacggtcggtacgtaacgggtcgggtcggtacggaccgtagggtacgttcaccgttctacacctacgacgtacgctacgccgtagtacgtactacgtacgtaacgttatttacgtaacgtttactttaacgtttacgttacgtacgtagtactaagttaacgttaacttaacgtcgttacccttaccgtttaccgttaaccgtttcgggaccggtacgggttaaccgaacggtccggttacggtaactaccgttaacgtaaaccgtaaccggttggttcccgtacggttaccgacgtacccgttaacg

SEQ ID NO: 69729 - DNA, 675 bp, Homo sapiens
  misc_feature: GYAE6OF02FKQZS.51.76.G10.1.454.CMB.1.raw
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagcgccaccctctcctgcacgggccaggtcagagtgttagcagcgacgttgcctggtaccagcagaacccnggaccacggcctcccgagacctcctcatctangatgacctataccgaacgaacgggccctaacgtgacttactcccagtcccgtaggttcgaggtcggacgtagggttcgggtacgtcgggaatacggtacgttcccaacttccgtaccacctagtccgagccgtacgtccgtacgctacggtacctaggtaacgttgttttacgactttaagttttacttaacgttgtacctacgtacgtaacgttaaagttaacgttaaccgttcgggttacccttaaccgttaccgtttaaccggttttccgggaacccggtacggggtaacccaaggtaccggtacgggtaacgtaaggttaaccccgtaaaggttaccgtacgggttaccggtcgtaccgtacccgtacgtaccg

SEQ ID NO: 69730 - DNA, 639 bp, Homo sapiens
  misc_feature: GYAE6OF02FYPO2.51.76.G10.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (354)..(354): a, c, t, g, unknown or other
  misc_feature (354)..(354): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtcctgtgtctccgaggggaaangccaccctctccgtgcagggccagtcaggagtgttagcagcgtactagcctggtaccagcagaacctggccaggctccgagctccncatcatgatgcatccacgacggccactgactacnccagcctagtcgagtcgcaggtgggtcgtagggaacngtacgttacacgttccaccacctatcgagacgacgtccgtgtcctacggtactaggtaacgtttagtttacgtactttaagttttacttacgttacgtaccgtaagtacgtaagttaacttaaacgttaaccgttaccggttacccgtttaaccgtttaaccttaaccggttttccgggaacccgttacgggggaaccgtaacgggtcgtaacgggtaacgtaacgttaaccgaaaccggttaacgttcgggtacggttacctaccggtacgtaacccttaccgg

SEQ ID NO: 69731 - DNA, 620 bp, Homo sapiens
  misc_feature: GYAE6OF02HDS2A.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccagcccaccctgtctgtgtctccgaggggaaagcgccaccctctcctgcagggccagtcagagtgttagcagcgacttagcctggtaccagcaagaaacctggccaggcctcccaggtcctcctcactctatgatgaccactccaacgaacgggccacgtgatactcccagccgtaggttcaggtgcgaggtcggtcgtgggacaggtacgttcacttctaccactactcgacgcgacgtctgccagtctagtaacgtagttttagacttaatttacttacgttgtacgagtactaagttaattaacgtaacgttcggtacccgttaccgtaacgttaccgtttacggaccgtacggggtaacctaacggtcgttaacgggaacggttaaccgtaaaccggtaaacggtaccggttacgggtaccgtaccggtaaccgtacccgtaacgttaccgg

SEQ ID NO: 69732 - DNA, 735 bp, Homo sapiens
  misc_feature: GYAE6OF02FMPS0.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcaggcgacttagccgttgggtacccagcaacgaaaccgtgggccacggcctccccgaggtcctccctacgacttcgtatcgatcgctactaccgaacgtaacgggacctacgtagactaaccgtcccaaggtcccgtaggttcaggtgggacagggttgggtcgtagggacaggtacgtttacacttcctccgaaccgtactaccgacgccgaacgcccgtacgaccgtagttaccgttaaggtaaagtttacgttttacgtaacgtttaaacgtttttaacgttacgtttagtaaccgtagtaacgtaaagtttaaactaaaccgtttaacgtaccggttaccgttaaccgtttaacgttaacggttttaccgggtaacccggtaacggggtaacccgtaacgggttacccggttacgggtaaacgtaaccggttaacccggtaaaaccggttaacggtacgggtttacggaccgttacggacccgttacccggttaaccg

SEQ ID NO: 69733 - DNA, 723 bp, Homo sapiens
  misc_feature: GYAE6OF02F01MO.51.76.G10.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcacgggccagtcagtgtgttagcagcgacttagcctggtaccagccaagaacctggaccaggcctacccgaggtcctcctnacttctagtgatcgactacgtaccaacgaacgggccaagtcggaactaccgtccccgagtcccgtaaggttccgaggttcggaccgtagggttcgggtacgtaggggaactaggtacgtttaccaaccggttcctacgacctacgtaccgaacgtaccgtacggtcccgtagtaccgtaacggttcgtaacggtaaacgtttacgttttaacggaaccttttaaagtttttacgttaacgttggttaccaaggttacttaaaggttaacttaaacgtttaccggttccgttacccgttacccgttaacgttttaccggtttaccgggacccggtaacggggtacctaacggttccggtaaggtaacgttaaccggtaacgtaaaaccggtaccgttcgggtaccggtacctacgggtaccctaccgttacg

SEQ ID NO: 69734 - DNA, 575 bp, Homo sapiens
  misc_feature: GYAE6OF02FR48U.51.76.G10.1.454.CMB.1.raw
  modified_base (197)..(197): a, c, t, g, unknown or other
  misc_feature (197)..(197): n is a, c, g, or t
  modified_base (395)..(395): a, c, t, g, unknown or other
  misc_feature (395)..(395): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtcgtctccaggggaaancgccaccctctcctgcagggccagtcagagtgtagcagcgacttagcctggtaccagcacgaaacctggccaggcctcccgaggcctcctcatctatgatgcatccacgaagggccatgactactcccagcctaggttcaggtcggctaggtcgggtactgggactaggtacttcacgttctacacctatcgacgtcncgtccgtgcgtacgttcgtagtattagtttgactttaattttacgttacgttgtactagtcgtaagttaattaacttacgtcgttaccttccgttacttacgtttcggacggtacgggtaactacggtcgtaggacgtaacttacgaacggttacgtaggtaccgtactcgactacgtac

SEQ ID NO: 69735 - DNA, 644 bp, Homo sapiens
  misc_feature: GYAE6OF02GAR98.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccacctgtctgtgtcctcgagggaaancgccacctctcctgcgagggccagtcagtagtgtagcagcgacttagccgtaggtacagcaagaacctggaccaggcctcccgaggtcctccgtacattctagtgactcgacctacgtacccaacgtaaccgggccctaagtcgacttaccgtacccacggtccgttaaggttcaacggttcggacgtgggttacgggttcgacgggaacaggtaccgttacacgttccgtaccacctactacgacgcgtacgtctgtactacggtactacgtagttcttacgaactttaatttacttacgtcgtacgtacgtactaagttaacttaacgtacgttcgtaccgttaccttacttacggttacgaccggtaacgggtaccgtacggtcgtaaggtaccgtaacgtaaacgtaacggtacgttcggtacggtactacggacctacgttaccg

SEQ ID NO: 69736 - DNA, 589 bp, Homo sapiens
  misc_feature: GYAE6OF02HJXMM.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtcgtctccgaaggggaaanacgcccaccctctcctgcagggccagtcagagtgtagcagcacttagcctaggtaccagcagaaacctggaccaggcctcccgaggcctcctcacgtactatgactgacactaccagacggccatgactactccagtcctaggtcagtgcgaggtcgggtctaggcaagtacgttcacgtccgtacctacactcgagtaccacggtcctgtacgtacgttcgtaagtaacgttatttacgacttaagtttactacgtcgtacagtactaacgttataacgtaccgtcgtacccgttacgtacgttacgttcggaccggtacggtaaccaggttcgacggtagtaacgtaaccggaacgtacgttcggtacgtaccgtacgccctagtacg

SEQ ID NO: 69737 - DNA, 609 bp, Homo sapiens
  misc_feature: GYAE6OF02FNMC9.51.76.G10.1.454.CMB.1.raw
  modified_base (198)..(198): a, c, t, g, unknown or other
  misc_feature (198)..(198): n is a, c, g, or t
  modified_base (374)..(374): a, c, t, g, unknown or other
  misc_feature (374)..(374): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcacttagcctgtaccagcagaaacctggccaggcctccaggctcctcatctatgatgcatccaacgacgggccactgactactcccgagcctaggttcaggtcggcgtaggtgggtcgtgggacagtacgttcactcncgaccatcgacgcacgcctgacagtctagagttatttacgatttaactttacttacgttacgtacacgtactaacgttaataacttaacgtcggtacccttacccggttacttaccgttttacgggacccggtaacggggtaaccctaacgggtccgtaacgggtaacgtaacgttaaccgaaacgggttaaccgttacgggttaccggaccgttaccggtacctaacccgtacg

SEQ ID NO: 69738 - DNA, 713 bp, Homo sapiens
  misc_feature: GYAE6OF02GG5KP.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaacagcccaccctctcctgcacgggccagtcaggagttgttagcagcgtacttagcctggtaccagcaagaaaccgtggccaggcctccccaggtcctcctcactctatgtactgctactccaacgaacgggccactgactacctcccagccgtaggttcaaggtcggactagggtcgggtctaggggaactaggtacttccgtaccgttcctacgtaacccgtactaccgaacggccaacggtcccggtagaccgttaccggttacgttaacgtaaggtttaacttttacggtaaccgttttaaattttaccgtttaacgttacgttacgtaacggtacttaaacggtttaaactttaaagttaacccggttaccgggtaccctttacccggttaaacgttaccggttttaccggaccgggtaacccgggtacgtaacggtacggttaacggacgtaaccgttaaacggaaccgttaacggttccggtacgggtacccttacggacccaacccggtttcg

SEQ ID NO: 69739 - DNA, 624 bp, Homo sapiens
  misc_feature: GYAE6OF02GZNSL.51.76.G10.1.454.CMB.1.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaagngcccaccctctcctgcgagggccagtcagagtgttagcagcgacttagcctggtaccagcagaacctggccaggctccaggcctccncatctatgatgcatccacgaacggccactgaactactcccgagcccgtaggttccagggtcggacgtagggtttcggggtcgtacggggactacggtacggtttcccaaccgttcctaccgaaccctactaccgaacggccaccgtccgtcgtaccgacggttactaggtaaacgttactttttcgaactttaagttttactttactaggttcctaagtacctaagttaattaacgttaacgtcgtaccttacgttaccttacgtttgacccggtagggtaccgaggtcgtaggtacgtaagtaccgaaacgtacgtcggtcggcgtacgacgtactacg

SEQ ID NO: 69740 - DNA, 920 bp, Homo sapiens
  misc_feature: GYAE6OF02IK5FV.51.76.G10.1.454.CMB.1.raw
  modified_base (149)..(149): a, c, t, g, unknown or other
  misc_feature (149)..(149): n is a, c, g, or t
tcagcgatcgtatacacgaccggtgctcgatttagtcactcatacagggggagaactgctcagttaggacccagacggaaccatggaagccccagcgcagcttctcttcctcctgctactctggctccagataccactggagaagtagngatgacgcagtctcgagccacctgtctgtacgtctaccgaaggggaaactgccaccttctccgtgacgacgggccaggttcgagtacgttggttacgcgtagtaccggtacttaggccgttagggtaaccccaggaccgtaacgtaaaacccgttgggaccctaacgggtccgttaccccgaagggtccctttaccgacgtaacgtttcccttaaggtacgttaacgtcggaaccttaaccgttaccccgaaacggtaaaccggggtccaacgtttacggtaacctttacccggtacccgaaacggtcccggttaaagggttccctaaagggttacgggccgtttaaacggggtttacggggttcccggtttaacggggaacctttaacgggttaaccggttttacccgacgtttacccgtacctaaccccgttagtaccgtaaccgggtctaaaccgtccggttacggtacccgtaacggtttcgtaaccgggttaagtttaccgtttaaggtaaacccgttttaaagttttaccgttacgtcggtaaacgttgaaaacccgtttaggtttaaaacctaacggttttaaccgggtccgtaaccccgtttaacggtttaaacgtttccgggttttaaccgggaccggttaaccggggtaaccggtttaccggttaacgggttaaccggtaacgttaaaccgttaaaacccgggaactttacgggggttacgggtaccgttcccggtaacttccccggaaagttttccccgg

SEQ ID NO: 69741 - DNA, 564 bp, Homo sapiens
  misc_feature: GYAE6OF02F5T2W.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctntcctgcagggccagtcagagtgttagcagcgacttagcctggtaccagcagaaacctggccaggcctcccaggcctcctcatctatgatgcatccacaagggccatgactactcccagcctaggttcaggtggctaggtggtcgtgggacagtacgttcactctacaccatacacgcagcctgctagtctagagttatttagacttaatttacttacgtgtacagtacgtaagttaattaacttacgtacggttcccttaccgttacgttaccgttttcggacccgtagggaccgtacggtcgtaggtaacgtaacgtacgtaaacgtacgtcggtacggtacgtcgtacaccgtacg

SEQ ID NO: 69742 - DNA, 671 bp, Homo sapiens
  misc_feature: GYAE6OF02IVQVH.51.76.G10.1.454.CMB.1.raw
  modified_base (488)..(488): a, c, t, g, unknown or other
  misc_feature (488)..(488): n is a, c, g, or t
  modified_base (614)..(614): a, c, t, g, unknown or other
  misc_feature (614)..(614): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagactaccactggagagtagtgatgacgcagtcctccagccacccctgtctgtgtcctccgaggggaaagacgcccaccctctcctgcgacgggccaggtcagtagtgttaagcagcggtacttgcctggtacagcagaacctggccacggcctcccgaggcctcctacactctactgactggccacgtaccaaccggaaccgggtccctacgtcgacttaccgtccccgacggtaccgttaggttaccgagggttcggccgtaaggggttggggttccgtacggggaactacgggtaacgttccgtaccctttcccgtaacccgtaaccgtctaccgaacggtacgccgtccggtacncgttacgtcgtaaggtagttacgtttagtactttaactttactgttacgactgacttaagtacttaaatacggtccgtccgttaccgttaacctacggtttccggaccgggtaggacccgtaaggnggtacggtaagaacgtaaccgaacgttacggtcgtagtcgtaccgtacaccgttacg

SEQ ID NO: 69743 - DNA, 964 bp, Homo sapiens
  misc_feature: GYAE6OF02J1T0I.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctggcacgggccagtcagtacgtgttacgcagcgacttagcctggtaccagcacgaaccgtggccgacggcctccccgaggtcctcccgtacacttaccgtattacggattcggctaaccgtacccgaacggtaaccgggggtacccctaacgttacggaactttaccgtacccccgaacgggttaccccgtaacgggttttacccggaacggggttacggggtacccgttaaacgggggttttcgggggtttaacccggtacggggggtaaaacccgtaaggttaacccgggtttttacccgaaccctttcccggtaaccccgtaacccgtacgttaccggaccgtaacccgtaaccgggttccctagggtaccgttaaccggttaacttaacgggttaacgtttaaggttttacctaacggtttaaactttttaccggtttaaccgtcggttaccgttaacgttaaccggttaaaccggtttaaacgttaaaaccggttttaaacccgtttcccgggggttaaacccccttttttaccccgggtttaaaacccggttttaccgggttttttaacccggggtaaccccccggggtaaagggggttaaaccccgggttaaaccggttaccgggttaaaccggggtaaacggttaaaccgtttaaaccccggtttaaaaccgggtaacccgtttagggggtttacccggtaacccgggtttaccggttaaacccccgttaacccggtttaacccgg

SEQ ID NO: 69744 - DNA, 574 bp, Homo sapiens
  misc_feature: GYAE6OF02I6RJM.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcagggccagtcagagtgttagcagcgacttagcctggtaccagcagaaacctggccaggctcccaggctcctcatctatgatgcatccacaggccactgatatcccagccaggttcagtcggcaggtgggtcgtgggacaggtacgttcacttcctcaccatccagcagcctgcacgtccgtaggtaagttattttcgacttaaatttatttacgtgtcgtagtacgtaagtaattaaactacgttcgtacccttaccgtacttacgttttacggaccgtacggggtaacctaacggtcgttacggaacggtagttaaccgaaaccgtaacgtcggttacggacctacggacctacgttaacg

SEQ ID NO: 69745 - DNA, 622 bp, Homo sapiens
  misc_feature: GYAE6OF02I7BFN.51.76.G10.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtacagcagaaccgtgccagctccagctcctnatctatgatgaccataccgaacgaacgggtccaacgttgactaaccgtcccgaagtcccgtaggttaccgaaggttcggaccgtagggtttcggggtacgtacggggaacgtaggtaacgtttcccaacgttccaaccgtacctaagtccgaacgcaagtccctaggctacgtcgtaaggtaacttgtttagaccttaagttttatacgttcacagtactaaggttaactaaagtaccgtcgacccttaccgtacgttacgtttaccggacctaggggacctagtcggtacgaagtaacctacgaaacgttacgtggtaaccgccgtacgtacctacgtacg

SEQ ID NO: 69746 - DNA, 580 bp, Homo sapiens
  misc_feature: GYAE6OF02JW8Q0.51.76.G10.1.454.CMB.1.raw
  modified_base (374)..(374): a, c, t, g, unknown or other
  misc_feature (374)..(374): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctctaggcctctcatctatgatgacatccacgtaacgggccactgatactccagccaggttcagtggcaggtggtcgtggactagacgttcacgtctcaactanacagcaacgcctgctacgtctagtaagtagtttagactaaattttacttacttacgtctaagataagtaattaaactaacgtcggtacccttaccgttaacttaacgttttacggaccgtacggggtaacctaaggtccggttaggaacgtaaccttaacgaaaaccggtaacgttcggttacggacgtacgaccgtaccctaacg

SEQ ID NO: 69747 - DNA, 644 bp, Homo sapiens
  misc_feature: GYAE6OF02HP6B5.51.76.G10.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
  modified_base (394)..(394): a, c, t, g, unknown or other
  misc_feature (394)..(394): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgcccacctctcctgcagggccagtcagagtgttagcagcgtattagcctggtaccagcaacgaaacctggaccagggcctcccgaggcctcctacntctatgatggctataccaagagggcccagtagactactaccagccgtaaggttccaggtggccgtagggttgggtctggggacaaggtcttccgacttccncacctacgacgtagcgtacgccgttgctacgtctaggtaacgttagtttacgtacttaaacgttttacttacgttacgttacgtaagtacgttaagtttaacttaaagttaaacctcgggttaaccttccgttaacgttaacgttttccggaccggtacgggtaacctaacgggtcgtacgggtaagttaaccgtaacggttaaaccgtacggttacggtaccggtacctaacggtaccacccgttaacg

SEQ ID NO: 69748 - DNA, 678 bp, Homo sapiens
  misc_feature: GYAE6OF02GVEEX.51.76.G10.1.454.CMB.1.raw
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcagggggaangccaccctctcctgcgagggccagtccagagttgttagcagccacttagccgtggtaaccngccaagtaaaccgtggccaggtcctccccgaaggccttcctcattcctatcgtatcggaccatacccaacggacgggccaacgttggactaccgtaccccgagcccgttaaggtttccgaaggtttcgggcgtaaggttggggtcctagggggtacagggtacgttcctaccgttcctaccgaaccgtactacgacgaccgtacggtcccgtgccgtaggttactagggtaaacgttacgttttaacgacgtttaaacgttttactttacgtgttccaagtacgtaagttaacgttaaacgttaacgtcggttacccttaaccggttaccgttaacgtttcggacccgtacggggtactaccggtacgtaggtaacgtaactaacgtaacgtaacgtcggtacgtcgtcgtaccacttaccg

SEQ ID NO: 69749 - DNA, 557 bp, Homo sapiens
  misc_feature: GYAE6OF02FNR66.51.76.G10.1.454.CMB.1.raw
  modified_base (198)..(198): a, c, t, g, unknown or other
  misc_feature (198)..(198): n is a, c, g, or t
  modified_base (290)..(290): a, c, t, g, unknown or other
  misc_feature (290)..(290): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanagcccaccctctcctgcagggccagtcagagtgttagcagcgacttagccctggtaccagcaagaaacctggaccaggctcccaggctcctnatctatgatgcatccacgaggccactgatactcccagccaggttcaggtcgcaggtcgggtctagggacaggtacgtttccacttctaccacactcagcacgcctgcgtagttctgaagttattttgacttaatttacttactgtactagtactaagttaataattaacgtgtaccctacgtactacgtttcggaccgaggggtaccaagtcgtaggacgtaacgttaccgaaacgtacgtaggtcggtactacggtaccaccgtac

SEQ ID NO: 69750 - DNA, 645 bp, Homo sapiens
  misc_feature: GYAE6OF02GD3DT.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccatggagaagtagtgatgacgcagtctccagccaccctgtctgtgtctcgaggggaaancgccaccctntcctgcagggccagtcagtagtgttagcgagcgacttagcctggtaccagcaagaaaccgtggccaggcctcccgaggtcctccctntacgtcctatggtatcgctacgtaccaacggaacgggcctaactagtactactcccgacgtccgtaggttcgaggttcggacgtagggtcgggtcgtagggacctaaggtcgttcgacgttcctacaccgactcacgtcgacgtcccgtagctacggttacgtaggtaagttacgtttttagaacgtttaatttttactacgttgtaccgtagtacgtaagttaaacttaacgtaccgtcggttacccttaaccgtaacgttacgtttacgaccgggtaggggacctaacggtcgtaaggtataccgtaaacgtaacgacgttcgggtacgtacgtacgtaccgaccgttacg

SEQ ID NO: 69751 - DNA, 759 bp, Homo sapiens
  misc_feature: GYAE6OF02H5BGX.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgccacctctcctgcgagggccagtcagacgttgttagcagcgtacttacgcctacggtaccagtacaacgaaaccgtcggaccacggtcctacccggacggtccttcctactaactacttacgtgtagttacgcctacgtacccaaacggtaaacggggcccctaacgttcgaacttacctaccccgtacggtacccgttaacggttaccgaagggtttcgggacgttacggggttaggggtacggttcggggtaaccaaggtaccgttaccgtaaccgttacctcccgtaacctaacgttccgaacgtccgacgtccgtacgtactacggtaccgtaggtaacgttatttacgtaacttaaagttttacttacgtagtaccgtaacgtactaaggttaaactttaaaccgttaacggttccgtacccgtttaccgtttaaacgttacggttttacgggaaccggtacggggtaaaccgtaaccggtcggtacggtaaggtaaccgttaaccgaaaacggttacgttacgggtaccgtccggtacgtacccaacccgttacg

SEQ ID NO: 69752 - DNA, 627 bp, Homo sapiens
  misc_feature: GYAE6OF02GJ9C7.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctccagcccaccctgtctgtgtctccgaggggtaanacgccacccgtctcctgccagggccagtccaggacgtgtacgccaggccgtaccttagccctgggtacccaggcagaacccgtggccacggcctcccacggcctcctcatcctatgatgcatccacgacgggccactcgactacgtcccagccaggttcaggtcggcgaggtcggtacgtggactagtacgttccacgtctccaccgtactcacggccacgtcctacgcctacgtacgtacgtaacggtacttttacgtacttaaactttacttacgttcgtccgtaacgtaccgtaaggttaactaaacttaaccgttacgggttacccttacccgttactaccgtttcggaccggtacgggtaccgacggtcgtacggacgtacgttaaccgaacgtaccgtggtaccggcctcgacctacctacg

SEQ ID NO: 69753 - DNA, 804 bp, Homo sapiens
  misc_feature: GYAE6OF02GYWQX.51.76.G10.1.454.CMB.1.raw
  modified_base (202)..(202): a, c, t, g, unknown or other
  misc_feature (202)..(202): n is a, c, g, or t
tcagcgatcgtatacacgaccggtgctcgatttagtcactcatacgagggggaggaactgctcagttaggacccagacggaaccatggaacgccccagcgcagcttctcttcctcctgctactctggctcccagataccactggagaagtagtgatgacgcagtctccagccaccctgtctgtcgtcctccgaggggaaacncgcccaccctcgtccgtgcgacgggaccagtcagagttgttagcagcgtacttagccgtaggtaccagcacgaaccgtggaccaggcctcccgaggcctcctctactctatgacttcgactacaccgaacgtaccgggccagtcgtactacgtcccaggccgtaggttcgagtgggaccgtagggtgggtcgtacggggacctaggttacttaccgaccttccgtaccgactacgtacgacgtaccgtacggtaccctggtaccgtaacggttcggttaacggtaacggtttaacgttttccgtacgtttttaaaacgttttacgtttaacgttacgttaaccgtaacgggttaccgtaaaagttttaaacctaaccggtttaacccggtttacccggaacccggttttacccggttaaaaccctttttacccgggtttacggggaaccccggttaaacccggggggtttaaccctaacggggttacccggttaacgggtaaacggttaaacccgttaaacccgggtaaaacccggtttacggttaccgggtttaccgggaacccggtttaacccgtacccgggttaacccctttaaccggg

SEQ ID NO: 69754 - DNA, 727 bp, Homo sapiens
  misc_feature: GYAE6OF02GZJCL.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtcctccagccacctgtctgtgtcctccgaggggaaanacgccaccctctcctgcgacgggccagtcagagtgttacgcagcgtacttacgccgtcggtaccagtcaacgaacctggccacggcctcccgaggtcctccctacaacttcgtaatgacgttcgaccactaccgacggtaaccgggccctacgtagacttacctaccgaacggtcctaaggtttccgaaggtccggacgttaagggttcggggtacgttacggggaaactacggttacgttaccgtaccgttccgtaccaacctaacgtcgaacgtacccgacgtcccgttacggaacgttcgtacgtagtaaaggtttactttcgaactttaagtttacttcgtacgtacgacgtactaagttaacttaaacgttacgttaccggtacccgtttaccttaacgttaccggttttaccggacccggtacgggtaaccctaacgggtcggtaacgggtaacgtaaccggtttaaaccaaacgggttaccgttagggttccggaacctacggtacccgtaaccgtaacgg

SEQ ID NO: 69755 - DNA, 684 bp, Homo sapiens
  misc_feature: GYAE6OF02F7TFV.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgtacttagccgtggtaccagcagaaacctggccaggcctcccgaggcctcctcatctatgatgcacgtccaacggaacggcccagtgactactcccgagtcctaggttcaggtgacgtagggtgggtcgtagggactaggtagttccaccttccgaccaacctagtccgaacgtcgaacgtcccgttacgccgtacgttactagggtaaacgtttacggttttacgaactttaaacgtttttaacgttaccgttgttaacgtaacggtccgtaaagtttaacgttaaacgttaaccggttaccgggtacccttacccgttaacgtttaccgttttacgggaaccgggtacggggtaaccgtaacggtccggtaaggaaccgttaacgtaaccggtaaaccggtaccggttaggttaccgggtaccgttacggtacctaacccgttacg

SEQ ID NO: 69756 - DNA, 650 bp, Homo sapiens
  misc_feature: GYAE6OF02GI1I6.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaangccaccctctcctgcagggccagtcagagtgttagcagcgacttagcctaggtaccagcaagaacctggccaggcctacccgaggcctcctcactctaatcgatcgacactaccaacgaacgggccaacgtagaacttaactccccgagccgtaaggttacgaggtcggaccgtagggttcgggtactagggggaacctaggtacgtttccaccgttccactaacctacgtacagaccgacgtccgtcgactacgttactaggaagttatttacgacgttaaattttacgttacgttgtctaagtacgtaagttaacttaaacttacgttacggtaccttacccgtaacgtttacgttttacgggacccgtaacggggaacctaacggtccgtaaggaacgtaaccgtaacgtaaaccgacgttcggtacggtcgtacgacaacccgttacg

SEQ ID NO: 69757 - DNA, 710 bp, Homo sapiens
  misc_feature: GYAE6OF02JU6R9.51.76.G10.1.454.CMB.1.raw
  modified_base (204)..(204): a, c, t, g, unknown or other
  misc_feature (204)..(204): n is a, c, g, or t
  modified_base (696)..(696): a, c, t, g, unknown or other
  misc_feature (696)..(696): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccctaccctgtctgtgtcctaccgaagggggaaanacgcccaccctcctcctagcagggcccagtcagagttgttagcctaggacgtacttagcctaggtacccaggacacggaaacctcggaccacggctccccgtagcctccgtacaacgtctatcgatcgtcacgtcaaccgacgggtaccacgtgtaactacaccgtcgaccgtagttcgacgtacggtcgtaacgggttcggtacggtacgggaaccgtagttaaaccggtacctaccggttcctaacccgtaaccggtaccttacggaaccgtacgtaccggacccgttgaacccgttaagtccgtaacggtaagttaccgttttagtactttaacgttttacttaccgttagtaccgtaattacgtaaagttacttaaacgtaacgttacgtccgtttaccgtacgttaacgttttccggaacggtacggtaaccgtacgtacggtcggtaactacgttaacgaaccggtagttacggtcgtaccgtacnccgtaaccgttacg

SEQ ID NO: 69758 - DNA, 670 bp, Homo sapiens
  misc_feature: GYAE6OF02JYE3K.51.76.G10.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgactgacgcagtctccagccaccctgtctgtacgtctccgaggggaaanacgccacctctcctgcnggaccagtcagagtgttagcaggcgtacgttanccgtgtacagcaagaacctggaccaggtcctccgaggtcctaccgtcacgttctaagtgtatcgactactaccgacgaacgggcctagtacgactacgcccgtagaccgtaggttcacggttaggcgtaacgggttcgggtcgtacggtaacgaacggttacgtaccgtacgtctaccgtacgtacgtacgtacgacgtacgtaccgtacgacgtacgtacgtacgtaacgttacgtttacgtacgttaacgtttaacttacgggggggttactacgtacgttacgtaacgttaacgtaacgttaacgtacgttaccgttaccgttacgttacgttacgtaccggtacggtacgtacggtacgtacggtacgtaacgtacgtaacgtacgtacggtacgtacgtacgtacgtacgttacg

SEQ ID NO: 69759 - DNA, 768 bp, Homo sapiens
  misc_feature: GYAE6OF02IKH8G.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggcctcccagactaccactggagaagtagtgatgacgcagtctccagccacctgtctgtgtctccgaggggaaagacgcccacccttctccgtgccgacgggccgagtccgagtacgttgttacgcacggccgaacgttacgcccgtacggtaccacgacctaacggaaccgtcggccgtaacggcccctacccccgagggtccctacccgtacctaacgttaccttagtcggtacgtcgacctactacccgaaccgtaaacggggtcccacgttacgacgtaccgtaccccgaacgtcccgtaaggttccggacggtcgggtacgtaacgggttcgggtacggttacgggacgttaggtacggttacctaccttcctaccaccgtacgaccgacggacgtaccgtcgtcgacgttataccgttaaggtacgtttacttttagaacttttaatttacgttactcgtactaagtagtaagttaactaacgttacggttcccgtaccgtttaacgtacctttaaccgggttaccgacccggggtacgggtaaaccttacggggtccgttaaacgggaacgttaaccgaaaaccggtaccgggtttaacttggggttaccgacccttaccggtaaccgtacgtttaccg

SEQ ID NO: 69760 - DNA, 544 bp, Homo sapiens
  misc_feature: GYAE6OF02GL2L8.51.76.G10.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (251)..(251): a, c, t, g, unknown or other
  misc_feature (251)..(251): n is a, c, g, or t
  modified_base (366)..(366): a, c, t, g, unknown or other
  misc_feature (366)..(366): n is a, c, g, or t
  modified_base (400)..(400): a, c, t, g, unknown or other
  misc_feature (400)..(400): n is a, c, g, or t
  modified_base (534)..(534): a, c, t, g, unknown or other
  misc_feature (534)..(534): n is a, c, g, or t
  modified_base (539)..(539): a, c, t, g, unknown or other
  misc_feature (539)..(539): n is a, c, g, or t
tcagcgatcgtatacacgaccggtgctcgatttagtcactcatacagggggaggaactgctcagttaggacccagacggaccatggaagccccagcgcagcttctcttcctcctgctactctggctcccagataccactggagaagtagtgatgacgcagtctccagccacctgtctgtgtctcgaggggaangccaccctntcctagcagggccagtcagagtgttagcagcgtacttagcctggtaccngcagaacctggaccaggcctcccgagggtcctcctactagtcctatcgtatcgctataccgacgaagggcccagttgaactctcccgagcctaggttcgagtggcaggttcggcngggacagtgtacactcacgacatcagctacgctncgtagtcgtagtagtgttttacgattaaatttctagtagtcagtagtagtaactaatacgtcggtacctaccgtgttacgtttcggaccgtacgggactaacgcgtaggactacacgaagtacgtggacgtacncgacncgtac

SEQ ID NO: 69761 - DNA, 1049 bp, Homo sapiens
  misc_feature: GYAE6OF02IWK95.51.76.G10.1.454.CMB.1.raw
  modified_base (208)..(208): a, c, t, g, unknown or other
  misc_feature (208)..(208): n is a, c, g, or t
tcagcgatcgtatacacgaccggtgctcgatttagtcactcatacagggggaggaactgctcagttaggacccagacggaaccatggaagccccagcgcagcttctcttcctcctgctactcgtggcctcccagactaccacgtggaagaggtagtgatgacgcagtcctccagcccacctgtcttgtcgtctaccgaagggggaaancgccctaccccttctccgtgccgacgggccaggtcaggtagttggttaacgcgaacgccgtaacttcgacccttaggtaaccacgtacaacgtaaaccgtcggacccagggcccttccccggaggtccttcccgtacgtacttaccgtagtacgtagttcgccttaacgccaacggtacgggtacccaagttacgtacgtacctacccgtaaggtccgtaacgggtttaccaagggtttccggacggttaacgggttggggttacccggttaagggggaccctaaagggttaccgtttcccggtaaacccttttccggtaacccgtaacgtttacccggtaacgtaaccggtaccgttaacccgggttacctaccgtaaccggggttaacgtttacccggttaacggtaaaccgttttacgtttttaaacggttacccgttttaaaacttttttaaacgggtttttacccgttacggtttaaaccggttaaacgttaaaccggtttaaaacgtttaaaaccggttttaaaaccggttaaaccccggttacccgggttttaaacccccggtttttaaacccgggtttaaaaccgtttttttaccccgggtttaaaacccggggggggtaaacccggggtttaaaccccggggggtttaaaaccccctttaaacggggggtttaaaccgttaaccggggggggtttaaaaccgtttaaaaccccggtaaaacccgggggttttaaaaaccgtttaacccgggggtttaacgggtttaaacccccggggggtttttacggtaaaccccgggttttaaccccgtacccccggttttaaacccggg

SEQ ID NO: 69762 - DNA, 711 bp, Homo sapiens
  misc_feature: GYAE6OF02FUOD5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccacctctcctgcacgggccagtcagacgtgtagcagcgacttagcctggtaccagcagaaaccgtggaccaggcctcccaggcctcctcacttctactgagtgcctatccaagaacgggcccacgttgaacttaccgtacccaggtccctaaggttcaggttcgggctagggttcgggtctacggggactaaggtcgtttaccacttcccgtaccaaccgtacgtacgacggtaccgacgtccgttcgcgtacggtccgtagtaagttacgtttacgtaacgttaagttttaaccgttacgttcggtaccgtacgtaccttaaggttaacttaaacgttaacgttaccggttacccgttaacccgttaacctttaaccggtttaccgggtaacggttacccccccgggtaacgtaaccgggtaccggttaacgggtaacgtaaccgttaacgtaaaacccggttacggtttacggtaccggttaccgttaccggtaccgtaccgttaaccgg

SEQ ID NO: 69763 - DNA, 727 bp, Homo sapiens
  misc_feature: GYAE6OF02I89II.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagactaccacgtggagaagtagtgatgacgcagtctccagccacctgtctgtcgtcctcgaagggaaancgcccacccttctccgtgaccgacgggccaggtccaggtaggttgttacgctacggcgtaccttaggccccttaggtacccaggaccaacggtaaacccgtcggacccgtaggacccgtacccgtaggccttaccgtcacgttctacgtgactcgtacgactaccgacggtaaccggcctacgtacgtactaccgtacccacgacccggtagtttacccgaaggtcccggagtacgggtcggttaccggtacgggaactaggtacgtttaccaccgtttaccctacgaacccgacgtaccgacgtaccgacgtaccgtcgacggtacgttagtacggtaacgttacgtttaacgttacgtttaacttttacttacgttaccgtaccttacggacttaagttaacttaacgtaacgtaccggtttacccttaccgttacgttacccgtttacgggaccggttacggaccgtaacgcggttacgaagtacgtaacgaacgtacgtaggtcgtacgtcgtaccgtacgtacg

SEQ ID NO: 69764 - DNA, 590 bp, Homo sapiens
  misc_feature: GYAE6OF02FKPYE.51.76.G10.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccnggctcctcatctatgatgcactccacgaagggccactgactactccagccaggtcagtcggacgtaggtcgggtcgtggggactaggtacgttacgacttcgtaccacacgtacagcacgccgtgcgtacgtctaggtaagttagttttgaccttaattttacgttacttgtacagtacgtaagttacttaaacttacgttacggtcccttaccgttaaccgttacgttttacggaccgtacggggtaccgtaacggtcgtaggaacgtactaaccgaaacgtaccgtggtacggacgtacggacctacgtacg

SEQ ID NO: 69765 - DNA, 838 bp, Homo sapiens
  misc_feature: GYAE6OF02H47F9.51.76.G10.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccacgccacccgtgtctggtcgtctaccgaggggaaanacgcctaccctcncctgcgagggccaggtcagtacgtgttaacgcagcgtattacgccgtacggtaccganacgaacgtaaaccggtggacctagggccctaccgaggccttccgtcaacgtccttagtcgtacgtcgaccgtactaccgtaaccggaacgggtcctaaccgtaggtaacttaccgtacccgtaaccggtaccggttacggtttacgaacggggttacggaccgttaggggttacggggttacggttacggggacgtaagggtaaccggttttaccgaacccgtttccgtaacccgtacccgtaagtcccgtaaccgtaccgacggtacccgtacggtaccgttacggttacccgttaggttaaaggttttaccgtttacggtttaacctttaaagtttttaacgttttaacggtcgtttaaaccggtacgttaaaccggttaaattttaaaacgttaaccggttaaacccggtacccggtttacccgtttaacccgttaacgttttaacccgggttttcgggaaacccggtacggggtaaccgtaacgggtccgttaggtaacgggtaacccttaagaaccggttacggtacgggtacctcgttaccgacccgtacgtttaccgg

SEQ ID NO: 69766 - DNA, 586 bp, Homo sapiens
  misc_feature: GYAE6OF02F9OXN.51.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagngtgttagcagcgacttagcctggtaccagcagaaacctggccaggctcccaggctcctcatcatgatgcatccacgaacgggccactgactactcccagccctaggttcagtggcgaggttgggtctgggacagtacgttcacttcacaccatcagcagcctgactagtctagtaatatttcgacttaatttacttacgttgtctagtctaagttaataaacttaacgtcggtacccttaccggttacttaccgttttcggaacccgtacggggtaacctaagggtaccgtagggtaacgtaacgttaacgaaaaccggtacgttacgggtacggtactacggtaccctaaccgtaaccg

SEQ ID NO: 69767 - DNA, 677 bp, Homo sapiens
  misc_feature: GYAE6OF02IKQUR.51.76.G10.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (283)..(283): a, c, t, g, unknown or other
  misc_feature (283)..(283): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctccgaaggggaaangcccaccctctccngcagggccagtcaggtagtgttagcagcgacttagcctaggtaccagcaagaacctggaccaggctcccgnggctcctcatctatgatcgcatccgaagaacgggccaactgaactacacccgagcctaggttccaaggttcggctagggtcgggtacgtggggaacacggttagttccgaacgttccgttaccaacctaacgttacgacggaccgaacgtccgtcggtaccgaacggttcgtaacggttaaacggttaagtttttaacggacctttaaatttttaacttacgttcgttacgtaacgtacgtaacggttaatttaaacgtaacgttacggtacccgttaccgttaacgttaaccgttttcgggaaccgtacggggaacctacggtccgtaagggtaactaacgtaaccgtaaaacggtacgttacggttacggccgttacggacctaacgtaccg

SEQ ID NO: 69768 - DNA, 533 bp, Homo sapiens
  misc_feature: GYAE6OF02GM4CL.51.76.G10.1.454.CMB.1.raw
  modified_base (196)..(196): a, c, t, g, unknown or other
  misc_feature (196)..(196): n is a, c, g, or t
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcagaaacctggccaggctcccaggctcctcatctatgatgcatccacaagggccactgatancccagccaggtcagtgcagtggctgggacagagttcactctcacatcagcagcctgcagtctagaagtattttagacttaaatttattaactgtcaagcagtaataaattaactggtaccctaccgttactacgttttaggacccgtaggggtacccaaggtcgtaggtaacgaacgtaacgaaacgtaacgtggtacggtacgtagaccacctaac

SEQ ID NO: 69769 - DNA, 554 bp, Homo sapiens
  misc_feature: GYAE6OF02IWL6N.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcagggccagtcagagtgtagcagcgacttagcctggtaccagcagaaacctggccaggcctcccgaggcctcctcatctatgatcgcatccaacgaacgggccactgactactcccgagcctaggttcaggtggctaggtgggtctgggacagtagttcactctcaccatcagcacgcctgctagtcgtagaagttatttagacttaatttattactgtacagactagttataaactacgtcggtccttaccgtacttacgtttcggaccgtacgggaacctaacggtcgtacggtacgtactacgaaacgtactcggtacggcgtacgaccgtactacg

SEQ ID NO: 69770 - DNA, 573 bp, Homo sapiens
  misc_feature: GYAE6OF02HCBY8.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaancgccaccctctcctgcgagggccagtcagagtgttagcagcgacttagcctggtaccagcaagaaacctggccaggcctcccaggcctcctcactctatgatgcatccacgaggccatgactctccagccaggttcagtggctaggtgggtctggacagtcgttcgactctcacatcgacgtcacgtccgtagcgtacgttccgtaggtaagttacgtttttgaacgtttaattttacttacgttgtacagtatagttaataactaacggtcgtaccttacgttaccgttacgtttcggacccggtacgggtactacggtacgtaggtacgtaacgtaacgaaacgttacgtaggtaggtcgtacggacctacgtacg

SEQ ID NO: 69771 - DNA, 642 bp, Homo sapiens
  misc_feature: GYAE6OF02FZ3L7.51.76.G10.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcgagggccagtcagagtgttagcagcgacttagcctggtaccagccagaaacctggccaggcctcccgaggctcctnatctatgatgcatccaagacggccactgactactccagtcctaggttcaggtgacgtaggtcggggtctagggactaggtacgtttaccgacttaccgtctaacctacgtacgacgtaccgacgtccgtgaccgtacggttcctaaggtaaggtttacttttaggaacttttaacttttaacttacgttagtaccgtaagtacgttaaacgttataaacgttaacgttccgggttacctaccggtttaccttacggttttccgggaccggaccgggtaactacgggtacgtacgggaagtaaccctaaacgtaacggtacttgggaccgtacgtcgaccgtaccgttacg

SEQ ID NO: 69772 - DNA, 711 bp, Homo sapiens
  misc_feature: GYAE6OF02IJYPX.51.76.G10.1.454.CMB.1.raw
  modified_base (144)..(144): a, c, t, g, unknown or other
  misc_feature (144)..(144): n is a, c, g, or t
  modified_base (177)..(177): a, c, t, g, unknown or other
  misc_feature (177)..(177): n is a, c, g, or t
  modified_base (192)..(192): a, c, t, g, unknown or other
  misc_feature (192)..(192): n is a, c, g, or t
tcagcgatcgtatacacgaccggtgctcgatttagtcactcatacgaggggaggaactgctcagtttaggacccagacggaaccatggaagccccagcgcagcttctcttcctctgctatctggctcccagataccacgtgganaagtagtgatgacgcagtctcagccacctgtcngtgctcgagggaaangccaccgtctccgtgcagggtccagtcaggacgtaggttacgctagcgtaacttagccctagtacgacgctaagaaaccttgggaccaaggcctacccaaggtccttaccgtctaactcgtaatcggtaacttcgcgtaactacccgaacgtaaacgggcctaacgtcggaataaccgtcccgaaggccgtaacgttcgaagttcggaccgaggtttcgggctttaacggggactaacgggttacttctaacgttactcctaacctcgttacacgtcgtaacgtcccgtagagtacgtaccgttaagtacggttaactttcggtaacttaactttaacgttaacgtcgtaacgtactacggttaacgttaacgttaaacgttacgtacggttaccctacggttaaacttaccgggttttagacccgggttacgggaaccctaacgggtacctagggtacgtaaacttaccggtaaaacgtaccgttacggtaggaccgtttaccggacctccgttaacg

SEQ ID NO: 69773 - DNA, 696 bp, Homo sapiens
  misc_feature: GYAE6OF02JR7ET.51.76.G10.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (236)..(236): a, c, t, g, unknown or other
  misc_feature (236)..(236): n is a, c, g, or t
  modified_base (487)..(487): a, c, t, g, unknown or other
  misc_feature (487)..(487): n is a, c, g, or t
tcagcgatcgtatacacgaccggtgctcgatttagtcactcatacaggggaggaacgtgctcagttaggacccagacggaacatggaagcccagcgcagcttctcttcctcctgtctactctggctcccagactaccactcggagagtagtgatgacgacagtctccagcccacctgtctgtagtctcgaggggaaancgccacctcncctgcacgggccaggtcagacgtgttanctagcgattacgcctaggtaccagactacggaaacgtcggccgaacggccttacccgaggtccttccaactactcgtaactggtatcggactactaccgacgtaaacgggccctacgtaagtaccgtactcccgaggtaccctaggttcccaaggttcgacgtagggtttacggcgttagggaacctgtaaccgggttcaaaccgtttcaacgtaaccctagtcgacgaaccgtacgtccgtacgtaccgngttaccgtagtacgttacggtttcgtaaccttaagttttagtactttacggttactacgtacttaacggtaactttaaggtaaccgttcggttacccttaccggttacttaccggtttacggaccggtaacggtaccgtaacgtcggtaaggtacgtaacctaacgttaaacgacggttcggtcgtaccgtacggtacctaccgtacgg

SEQ ID NO: 69774 - DNA, 578 bp, Homo sapiens
  misc_feature: GYAE6OF02G7UPT.51.76.G10.1.454.CMB.1.raw
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggcctcccaggcctcctcatctatgatgcactccacgagggcccagngtatactcccagccaggttcaggtggcaggtggtcgtgggacagtacgttcacttcacaccatcagcacgcctgctagtctagagttagtttgacttaatttattacttagtcactagtaagttaataaacttaacgttacggttcccttacgttacttaccgttttcggaccggtacggggtaaccaacgggtcgtacgggaagtaacgtaaccggtaaaacgtaacggttcgggtaggtaccgtacggaccacgttaccg

SEQ ID NO: 69775 - DNA, 777 bp, Homo sapiens
  misc_feature: GYAE6OF02HBA0N.51.76.G10.1.454.CMB.1.raw
  modified_base (110)..(110): a, c, t, g, unknown or other
  misc_feature (110)..(110): n is a, c, g, or t
  modified_base (131)..(131): a, c, t, g, unknown or other
  misc_feature (131)..(131): n is a, c, g, or t
  modified_base (197)..(197): a, c, t, g, unknown or other
  misc_feature (197)..(197): n is a, c, g, or t
  modified_base (397)..(397): a, c, t, g, unknown or other
  misc_feature (397)..(397): n is a, c, g, or t
tcagcgatcgtatacacgaccggtgctcgatttagtcactcatacagggaggaactgctcagttaggacccagacggaaccactggaagccccagcgcagctctcttccncctgctactctagctcccagntaccactggacaacgtagtgatgacgcagtctccagcccacctgtctggtctctccgaggggaaancgccaacccttgtcccgtgccctagggccctaggtaccaggacgttgttaacgcgaccgagactttcgggcttcggtaccaggcctaacggaacgtcggccacggccttcccgaggtcctccgatactcccgtatcggtacctaggccattacccgaccggaaacgggtcctaacccgtagaattacctcccggtaaacnccaccggtttaaccgcggtacgggctaacggggtttcggggtcttaacgggtacccgaggtttaacggtccttaacccgtacgtttaccgaacccgttacctacgtaacggtcccgaaaccggtacgttaccggcgtaacccggttcgtaaggtaccgttaacgggttttacctaacccgtttagtttaacctttaagtttacgacggttaacggttacttaccggtaaacttaacgttaacgtacgtaccgttaccggttaaccttacgtttacccgggtacttaccggggaagtaccggtaacgtaaccggtttaggaaccttacgggaaaaccttcgtaacgggtaaccgtttcggaccgttaccggtactaaccgg

SEQ ID NO: 69776 - DNA, 585 bp, Homo sapiens
  misc_feature: GYAE6OF02GTQOV.51.76.G10.1.454.CMB.1.raw
  modified_base (284)..(284): a, c, t, g, unknown or other
  misc_feature (284)..(284): n is a, c, g, or t
  modified_base (291)..(291): a, c, t, g, unknown or other
  misc_feature (291)..(291): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctccagccaccctgtctgtgtctccgaggggaagagcccaccctctcctgcagggccagtcagagtgttagcagcgacttagcctggtaccagcagaacctggccaggctcccaggctccnatcatgntgcatccacaacgggccactgactactcccagccaggttcaggtggcagtgggtctgggacngtagttccactccgtcacctatcagccacgcctcgactacgtcctaggtaacgttagttttacgacttaattttaacttacgttacgtacacggtactaaggtttaactaaagttaaccgtcgttacccttaccgttacttaccgttttggacccgagggacctaacgtcggtaggtaacgacgttaaccgaaaagtaccgttagggtaccggtcgtcgtaccacgttaacg

SEQ ID NO: 69777 - DNA, 624 bp, Homo sapiens
  misc_feature: GYAE6OF02GMY0S.51.76.G10.1.454.CMB.1.raw
  modified_base (285)..(285): a, c, t, g, unknown or other
  misc_feature (285)..(285): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgacttagcctggtaccagcaagaacctggccaggctcccgaggctccncactctatgatgacactaccacgaacggccactgactactcccagcctaggtcagtgcaggttcggtcgtgggacaggtacgttcctacgtcctcacctatacgacgcacgtcctgcgtacgtcgtagtaacgttagttttacgacgtttaaattacgtttactagttctaacgtacgtaagttaactaaacgtttaaccgtcggttaccctttaccgtaacgtttaccgttttacgggacccggtaacggggttacccgtaacggtcggtacgggtaacgtaacgtaaccgtaaaccggtaacggttcgtacggtaccgtacgaccgtacccgttacg

SEQ ID NO: 69778 - DNA, 819 bp, Homo sapiens
  misc_feature: GYAE6OF02IX6NU.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcgaggccagtcaggtgtgtagcagcgtacttagccgtggtaaccagcctaacgaaaccgttcggacccagggccctcccgaggtcctcctcgactctatggatcgacactaccgaacgacggcccacgtcgaacttacctcccgaacgtcccgtaaacggtttcaagggtcggacgttaacggggttcgggttaaacgttacggggaaaccgtgggttaaccgtttacccgtaaacccggttcccctttaaaccgtaaaccccgtaacgttaccggtaaaccgtacccgggtaacccggtccccggtgggtacccgttaagggttaccgtttaacggtaaaacggttttacggttttaacggtttactttaaaacgttttttacgttaccggttacgttaacggttaacgtaaccttaaaggtttaacgtttaaaacctttaacgccgggtttaccccctttaaaacggttaccgttttaacccggtttagggggaaccccgttaacgggggaacccttaacggtaccggtaacggttaaacgtaaccgaaacccgttaacggtaacgttacgggtcggtacccgtaacggtaacccgacctttaacgg

SEQ ID NO: 69779 - DNA, 676 bp, Homo sapiens
  misc_feature: GYAE6OF02I7QF1.51.76.G10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcacgggccagtcagagtgttagcagcgacttagcctggtaccagcagaacctggacccaggcctacccaggccttccnctatctacgtgatncactaccgaacgacgggccctatggactacctcccgacgccgtaaggtttccgaaggttcgggaccgtagggtcgggttcgtacggggaactagggtacgttccaacttccgtaacctaaccgtactaccgacgtaccgaacggtcccgacggtctacggttaccgtaacggtaagtttacgtttacgttacttaaactttttactacgttcgtactacgtagtaagttaactaacgttaacgttccggtaccttaccgttaaccgttcgtttaccgggtaacggtacgggtaccgaacggtccgtaagggtaataaccgttaaaccgtaacggtacgttcggtacggtaccgtccgtacgtccgttaacg

SEQ ID NO: 69780 - DNA, 670 bp, Homo sapiens
  misc_feature: GYAE6OF02F6LHW.51.76.G10.1.454.CMB.1.raw
  modified_base (195)..(195): a, c, t, g, unknown or other
  misc_feature (195)..(195): n is a, c, g, or t
  modified_base (332)..(332): a, c, t, g, unknown or other
  misc_feature (332)..(332): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaanagccaccctctccgtgcgagggccagtcagagtgttagcagcgacttagcctggtaccagcagaacctggccaggcctcccgaggcctcctcatctatgatcgacactaccaacgaacgggccagtacgacttaccncccgagccgtaggttaccaggttcggcgtagggttcgggtacgtggggaactaggttacgttaccaccgttcctaccaccgtactcgagccgacgccgtgctacggttctagtaagttattttcgaacttttaaatttacgttacgtgtacgtaatacgtaagtttaaacttaaacgttacgttaccggttaccgttaaccctttacggttacgttttacggggacccggtaacggggtaacctaacgggtacggtttaacgggaacgttaaccgtaaaccggtaaaccgtacgggttagggtaccggtaccggtaacgtacccgaaccgtttacccg

SEQ ID NO: 69781 - DNA, 652 bp, Homo sapiens
  misc_feature: GYAE6OF02IG5WK.51.76.G10.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtntctcgaggggaaangccacctctcctgcagggccagtcagtagtgtagcagcgacttagcctggtaccagacaagaaacctggccaggcctcccgaggcctcctcaatctatgatgacctatccaacgaacgggccaacgtgaactactcccgaagtcccgtaaggtttacaaggttcggactagggttcggggtctacgggactaaggtacgtttaccacgttcctaccgaacctacgtactacgctaacgtaccgtcgtacgacgttacgtacgtaagttaacgttttacgtactttaaatttaactttaacgttacgtacagtacgtaagttaagttaaacgttaacgtacggtaccgttaccgttacgttaccgttttacggaccgtacgggtaaccgtaacggtacgtacggtacgtaacgtaacgtaaacgtaacgtacggtacggtacgtacgtaccactacg

SEQ ID NO: 69782 - DNA, 718 bp, Homo sapiens
  misc_feature: GYAE6OF02GKC9M.51.76.G10.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccaccctctcctgcacgggccagtcagtaggtnttagcagcgtacttagcctaggtaccagccaagaacctggaccaggtccctacccgaggccttcccctanacttacctagtcgattccggactacgtacccgaacggaacggggtacccacgttagtacttaaccgttccccgaagtacccgtagggtttaccaacggggtttcgaccggtaggggtttacggggtccgtaggggaacttagggtacgttaccacgttccctaacgacccgtagcctaggaccacgtccgtgtaccacggttacgtacggtaaacgttcgttttacaacgtttaattttacctaccgttctaacgtacgtaacgtaaagttaaccttaaggttaaccggtcggttaccctttccgttaaccttacggtttacggaccggtaacgggtaccgtacggttacgaagggtactaacggtaacccgtaaaggtaccgttacggtcggacctccgtaccggtacttacgg

SEQ ID NO: 69783 - DNA, 634 bp, Homo sapiens
  misc_feature: GYAE6OF02HJAED.51.76.G10.1.454.CMB.1.raw
  modified_base (194)..(194): a, c, t, g, unknown or other
  misc_feature (194)..(194): n is a, c, g, or t
  modified_base (413)..(413): a, c, t, g, unknown or other
  misc_feature (413)..(413): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccaggggaangcccaccctctcctgcagggccagttcgagtagtgttacgcagcgacttagcctggtaccagcagaaacctggccagggcctcccgaggcctcctcatcctagtgatgacatccacgaacgggcccattgaactacctcccgagtcccgtaaggttccgaaggtcgggactagggttcgggtcgtcggggactaggaccgttcacttcctacgaccctntacgacgactacgcccgtgaccgacgttcgtaacgtaaggttcttttacggaacttaagtttttagtaaccgttgtacgacgtaccttaggttaactaacgttaaacgtcggtacccttaccggttactacgtttacggcccgagggttaccacggtcgtagggaacgtacgttaaccggaaaggtacgttacggtacgtacgttaccgaccacgttaccg

SEQ ID NO: 69784 - DNA, 741 bp, Homo sapiens
  misc_feature: GYAE6OF02HWVPB.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccgaggggaaagcgcccaccctctcctgcagggccagtcgagagtgttagcagcgacttacgcctaggtaccagcaaacgtaaccgtggaccgacggcctaccccgaggtcctccgtacacgttctagtgtactcgacactaccgaacggaacgggtccctacgtagtacttaaccgtaccccgaggacccgttaacgggttaccgagggttccgggtacgtacggggtttcggggttaccgtagggggaaccgtagggttaaccgttacctaaccgtccgtacccgaactacgtccgaacgtaccgtaacgtcccgtagaccgttacgtcgttaagtaacgtttaagttttacgtaacgtttaaatttttaactacgttagtaccgaagttacgtaagttaaacgttaacttaacggtccggttaccccgtttacggtaaccgtttccggtttacgggacccgggtaacgggtaccctaagggtcgtaacgggaagttaaccgaaccggtaacgtacgttccggtaacggtaccgtcggtaccctacgttaccg

SEQ ID NO: 69785 - DNA, 691 bp, Homo sapiens
  misc_feature: GYAE6OF02FYBO0.51.76.G10.1.454.CMB.1.raw
  modified_base (216)..(216): a, c, t, g, unknown or other
  misc_feature (216)..(216): n is a, c, g, or t
  modified_base (263)..(263): a, c, t, g, unknown or other
  misc_feature (263)..(263): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
tcagcgatcgtatacacgaccggtgctcgatttagtcactcatacaggggggtagggaacctgcctcgagtttacggacccagacggtaaccatggaagccccagcgcagcttctcttcctcctgctactctggctccagataccactggagaagtagttgatgacgctaagtctccagccacctgtctgtgtctccgaggggaaagagccacctncctgcgacggcagtcagacgtgttacgcagcgacttagcctgtaccngcagaacctggcaggctccgngctcncatcgagtgagtcgcactaccaacgaacgggtccaagtgaactactaccccagaccgacggtttacgagttcggacgtaggggttagggtccgttagggaactaaggtacgtttaccgaaccgttccgtaaccaaccgtaacgtaaccaacgaccgaacgtcccgttagacctacggtacctaggtaaacgttaacgttttaggactttaaacttttaacgttaaccgttcgtaccgaagtaccggtaaagttaacgttaaagtttaaaccgtcggttaacccttaaccgttaaacgtttacggttttaccggaccggtacggggtaacctacgggtacgtagggaaacggtacgtaacgaaacggttacgtacgggttacgtccgtacggacctacctacg

SEQ ID NO: 69786 - DNA, 745 bp, Homo sapiens
  misc_feature: GYAE6OF02F3F98.51.76.G10.1.454.CMB.1.raw
  modified_base (164)..(164): a, c, t, g, unknown or other
  misc_feature (164)..(164): n is a, c, g, or t
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcnccagccaccctgtctgtgtacctccgaaggggaaanacgcccaccctctcctgcagggccagtcagagtgtagcagacgacttagcctggtaaccagcaagaaacctggacaggcctacccgnggcctccgtcattcctatacgattcgcactaccgaacgaacgggcctaacgtcgaattaaccgtcccaagtaccgtacgggttacaacgggtgggacctaaggggttcggtacgtaggggaaccgtaagtacggtttaccaccgttacctaccgtaacctaacgtccgaaacggtccgaacggtcccgttagaccgttacggtacgtaggtaaacgtttgttttacgaactttaaagtttttaacgtaccgtttagtaccggtaacgtacgttaaacgttaaattaaaaccgttacggtaccggttaccctttaaacggtaaaccgttttaccggtttacgggaacccggtaacgggggtaaccctaaagggttccggtaaacgggtaacgaaccgtaaaccggttaaaagtaaccgtttcgggtaacccggttcgtaacggtaccccctaagttacg

SEQ ID NO: 69787 - DNA, 672 bp, Homo sapiens
  misc_feature: GYAE6OF02IALW0.51.76.G10.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (293)..(293): a, c, t, g, unknown or other
  misc_feature (293)..(293): n is a, c, g, or t
  modified_base (434)..(434): a, c, t, g, unknown or other
  misc_feature (434)..(434): n is a, c, g, or t
tcagcgatcgtatacacgaccggtgctcgatttagtcactcatacgagggggaggaactgctcagttaggacccagacggaaccatggaagccccagcgcagcttctcttcctctgctactctggctcccagataccactggagagtagtgatgacgcagtctccagcccaccctgtcctgtcgtctccgaggggaaacncgccaccctcnccgtgacgacgggctacgtcagagttgtagacagccgtattacgccgttaggtaccaggcaacggtaaaacccgtgggaccngggtaccctacccgacggtcctcctcacttcctagttgactcgacctactccgaaggtaccggcaacgttgactactccgacgtcgtaacggttcaagtcggagtcggtacgggtcgtaggactacggtacgttttacccnccgttacgtaccctaagacgtacgtacggcgtaccgtaccgtacgtaccgtcggttaacgtaggttaagttacgtttacgtaacgtttaattttaacgttacgtcgataacgtacgtaaagttactaacgttaccgtaccgtaccgttaccgtacttaccgggttaggtacggacgtacgtacgtcgtaaggacgtaacttaaccggacgtagtcgtacggtaccgtgacctactacg

SEQ ID NO: 69788 - DNA, 533 bp, Homo sapiens
  misc_feature: GYAE6OF02FHK0T.51.76.G10.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
  modified_base (485)..(485): a, c, t, g, unknown or other
  misc_feature (485)..(485): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggggaaanagccaccctctcctgcagggccagtcagagtgttagcagcgacttagcctggtaccagcagaacctggccaggctcccaggctcctnatctatgatgcatccacaagggccatgatactcccagcctaggttcaggtggctagggtgggtctgggacaggtatttccactcctcacctatcacgcacgcctgcagtctagaagtatttgacttaatttacttactgtctagtctagttataatacgtcggtaccttcgtacttcgtttcggccgtagggacgaacgngtacggagactacgtaaacgtacgtcgtacggcgtcgacctacctacg

SEQ ID NO: 69789 - DNA, 706 bp, Homo sapiens
  misc_feature: GYAE6OF02IFGKK.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcgagggccagtcagtagtgttagcagccgacttagcctggtaccagcaacgaacctggccagcctcccaggcctcctcatctatgatgacactaccacgacggccacgtgactactcccagtccaggttcaggtcggcgaggttcgggtcgtacgggacgtagtacggttaccacggttcctaccgaacctacgtaccgacgaccgtaacgcccgtgtaccgtagttccgtaggttaaagtttacgtttttacgtaacttttaacgtttttaatttaccgttacggtacttaacggttacttaaaggtttaacttaaacgttaacggttaccggttaccccgtttaaccgttaacgtttaccggttttacgggacccgttaggggtaacccggttaaccggtaacggtaacgggtaacggtaaccgttaaaccggtaaaccgttaacggttaccggttacgggtaccgttaccggtccgtaaccctttaaccgg

SEQ ID NO: 69790 - DNA, 616 bp, Homo sapiens
  misc_feature: GYAE6OF02GIN5H.51.76.G10.1.454.CMB.1.raw
  modified_base (197)..(197): a, c, t, g, unknown or other
  misc_feature (197)..(197): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtcgtctccgaggggaaanagcccaccctctcctgcagggccagtcagagtgttagcagcgacttagccgtggtacccagcaagaaaccctggccacggcctcccgaggcctcctcatctatgntgcatccagaacggccagtgactacnccacgccaggttcngtggctaggtcggtcgtgggacagtacgttccacttcgtacaccgatacacgactaacggtcctgcgtacgttaccgtaggtaacgttagtttcgtaactttaatttacttattcggtacagtactaagttaataaacgttactaccgggtaccttaccgtaccgttacgttttcggaccggtacggtacccgtaagtcggttaacggtaacggtaaccttaaccgtaaacggtacggttacggttaccggtcgtcggtacccaccgtttaacg

SEQ ID NO: 69791 - DNA, 597 bp, Homo sapiens
  misc_feature: GYAE6OF02F69JP.51.76.G10.1.454.CMB.1.raw
  modified_base (421)..(421): a, c, t, g, unknown or other
  misc_feature (421)..(421): n is a, c, g, or t
  modified_base (453)..(453): a, c, t, g, unknown or other
  misc_feature (453)..(453): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcacgggccagtcagagtgttagcagcgtacttagcctggtaccagcaagaaacctggccagggcctcccgaggcctcctcatctatgatgcatccaacgagggccaagtgatactccagcctagttcaggtggctaggtgggtcgtgggacagtacgttccattcaccgaccatcaggcagtcccgtgacctaggttactaggaagttnttttaggacttaaattttacgtacgtcgtacngactaagttaaactaactacggtcgtacccgtacgttacgttacgttcgggaaccgtaccggggaactaggtaccggaggtaacgtactaaccggtaaacgtaccggttcgggtacggtacctacccggacctacccgttaacg

SEQ ID NO: 69792 - DNA, 644 bp, Homo sapiens
  misc_feature: GYAE6OF02JQGBL.51.76.G10.1.454.CMB.1.raw
  modified_base (112)..(112): a, c, t, g, unknown or other
  misc_feature (112)..(112): n is a, c, g, or t
  modified_base (155)..(155): a, c, t, g, unknown or other
  misc_feature (155)..(155): n is a, c, g, or t
  modified_base (196)..(196): a, c, t, g, unknown or other
  misc_feature (196)..(196): n is a, c, g, or t
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
  modified_base (398)..(398): a, c, t, g, unknown or other
  misc_feature (398)..(398): n is a, c, g, or t
  modified_base (606)..(606): a, c, t, g, unknown or other
  misc_feature (606)..(606): n is a, c, g, or t
tcagcgatcgtatacacgaccggtgctcgatttagtcactcatacagggaggaactgctcagttaggacccagacggaaccatggaagccccagcgcagctctcttctcctnctactctgactccagactaccactggagaatagtgactgacgntagtctccagccaccctgtctgtcgtctccgagggaaagcnccacctctcagcagggtccagtcaagtgtgtagcngcgacttgcctgaaccngacacgaacctggcctaggcctccgacggtctcctcagtacctanggtatcgcactaccgtaacgagcccgtatgaactacgtcccacggacttacggtacacggttcggccaagggttcgggtcgaggtaccttagggcgtttaacccntacccgtcaaccgtacgtacgactacgtaacgccgttcggactacgtacgtaacgtaagttacgtttattaacggttaactttaacgtcgttacgaatacgggtactaaggttaacttaagtaacgtcgttaacccgtaccgtattacgttaccgtacggtacgggaccgtaagtccggtaaggttacgtacgaactaaacccggttnttacccggtaggtacccgtacggtaccctaagttaccg

SEQ ID NO: 69793 - DNA, 829 bp, Homo sapiens
  misc_feature: GYAE6OF02GG10D.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccgaggggaaagagcccaccctctcctgcgagggccagtcagagtgtagcagcgacttagcctggtaccagcaagaacctggaccaggcctcccgaggtcctccgtcatctaatgatgctactcccgaacgaaacgggccctaacgtagtacttaaccgtaccccgaacgtccccgtaagggtttaccgaaggggttcggtaccgtaggggtttcgggggttacgttacggggggaactaacggggttacgtttacccgtaccctttacccgtacccaacccgttaacttacccgaacggtcccgtaacgggtcccgttacggtcccgttaacggttaccgtttaacgggtaaaacgttttagttttttaaccgaaccgtttttaaaagtttttaaccgttttaacgtttacggttaacgttaacggtaacgtttaaaggtttaaaccgtttaaaacgtttaacccggtttaccgggtttacccccttttaacccggttaaccgtttttaaccgggtttttaccggggaacccgggttacgggggtaaaccctacgggtaacggttacgggtaaccggtaacgttaaaccggtaaaccggttaagttaccggggttacggtaccggtacggtacctaccgttacg

SEQ ID NO: 69794 - DNA, 787 bp, Homo sapiens
  misc_feature: GYAE6OF02F6ADC.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtcgtctccgaggggaaacncgccaccctctcctgcgacgggtccagtcagagtgtagcagcgacttagcctggtaccagacaacgaaaccgtggaccgaggcctacccgagtcctccgtcacttctaagtgtaactcgacgactaccgaacggtaacgggcctaacgtacgaacttaacctaccccgaacggtacccggttaacggtttaccgaacggggttcggaccggttaagggttcggggttacgtacggggggtaaacctaggttaacggttacctaccggttacctaccgaaccctaacgtccggtaacgaccgtaaccggtccgttaacggactaacgggtttaccgtaaaggttaaacggtttactttttaacggaccttttaaagttttaactttaccgggttacttacgtaacgttacctaaaacggttaaatttaaacgtaaaccgggtttccggtaaccgtttaaacccgttacgtttacggtttacccgggaaccgggttacgggtaaccgtaagggtccggttaagggaacttaaccggttaaccgaaaaccggttacggttggtaccggtacgtacccgtactaaccgttacg

SEQ ID NO: 69795 - DNA, 618 bp, Homo sapiens
  misc_feature: GYAE6OF02GHYI1.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagcctaggtaccagcagaaacctggccagcctccgaggcctcctcatctatgatgcactccacgacggccacgtgtactactcccgagccctaggttcaggtcggctaggtcgggtctaggggactaggtacgtttccgacttcctaccacctactcgacgtcgacggcccgtagacctacggttcgtacgtaacgttagttttacgacttaatttacttacgtcgttacaacgtactaagttaacttaacgtaacgtcggtaccttaccgtaccttacgttttcggaccgtacggggtaacctacggtcgttagggaacgtaacgtaaccgtaaacgtaacgttagggtaccggtcgtacgaccgtacccttacg

SEQ ID NO: 69796 - DNA, 801 bp, Homo sapiens
  misc_feature: GYAE6OF02HW5PS.51.76.G10.1.454.CMB.1.raw
  modified_base (146)..(146): a, c, t, g, unknown or other
  misc_feature (146)..(146): n is a, c, g, or t
  modified_base (166)..(166): a, c, t, g, unknown or other
  misc_feature (166)..(166): n is a, c, g, or t
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
  modified_base (781)..(781): a, c, t, g, unknown or other
  misc_feature (781)..(781): n is a, c, g, or t
tcagcgatcgtatacacgaccggtgctcgatttagtcactcatacaggggaggaactgctcagttaggacccagacggaaccatggaagcccccagcgcagcttctcttcctcctgctactcgtcgctcccagatacccactgganaagtagtgatgacgcagtcncagtccacctgtctgtntctccgaagggtaaacncgtccctacccttctactggccgtagggccaaaggtcaagtagtcgtaagccgtagcgtaacttacggcctaggaacctacgactaacggaaaaccctggaccgacggtccgtaccccgaacggtccctcccgtactaacgtcgtaacgtgaactttcgacctaacgttaacccaaaccggtaggaaccccgtaacgttacgtaacgttaacgtccccgaacggtacccgttaacgggttaaccgacgggtttacgacggtaacgggttcggggtttacaccgggggaaaccgtaaggttacggttaccctaccttacccggtttaaccaaccgtaccggttaacaccgtaccgtacgttacccggtacggtaccgaacgttacgttaacggttaaacgtttaccgtttaaggtaaacctttaagttttaacgttaccgttagtaccgtaagtcgtaaacgttaacgtaaattaacggccgggtttaccttaacgttacgtttaacgttacgggtaccggacgggtaccctaaggtacggttacggaacgttaactaacgtaaccggtaacttcgggtacncggtaccgtaccgtctaacg

SEQ ID NO: 69797 - DNA, 728 bp, Homo sapiens
  misc_feature: GYAE6OF02JYF5K.51.76.G10.1.454.CMB.1.raw
  modified_base (204)..(204): a, c, t, g, unknown or other
  misc_feature (204)..(204): n is a, c, g, or t
  modified_base (340)..(340): a, c, t, g, unknown or other
  misc_feature (340)..(340): n is a, c, g, or t
  modified_base (661)..(661): a, c, t, g, unknown or other
  misc_feature (661)..(661): n is a, c, g, or t
tcagcgatcgtatacacgaccggtgctcgatttagtcactcatacaggggaggaactgctcagttaggacccagacggaaccatggaagccccagcgcagcttctcttcctcctgctactctcggcctcccagactaccactggagaagtagtgatgacgcagtctccacgccaccctgtcctgtgtcctaccgaggggaaacncgccacccgtctcctggaccacgggccaggtccgaggtaggttacggttacgcgtaacggcgtacttacgccccgttaggggtaacccaggcaaaccggtaaacctcgggacccagggccctacccggaggtcccnccgtactactacgactgactcgactacgaccaacgaacgggcccctatagtactaccgtacccgagtacccgtaagttccgaggtcgcgtagggtcggtcgacggaactggtaccgttaccacgtccttaccgacctactacgacgacgaccggtccgtacgtacgttacggtccgttacgtaaaggttcctttaaggttacctttaacgtttaacgtagttcggtaactggaacgttaataacgttaacgtaacgtcgtaacccttacgttagttacccggttcgtacggaccgggtactaacgggtctaacgggttaancccgttaaaccggaaaggttaccgtcggtttaaccggaacccgtcccggtaacctaccggttaaccg

SEQ ID NO: 69798 - DNA, 626 bp, Homo sapiens
  misc_feature: GYAE6OF02JH9T1.51.76.G10.1.454.CMB.1.raw
  modified_base (195)..(195): a, c, t, g, unknown or other
  misc_feature (195)..(195): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgacttagcctggtaccagcaagaaacctggccaggcctcccgaggcctcncatcgtangatgcatccacgacgggccatgatactcccgagcctaggttcacggtggcctaggttgggtactggggaacctaggtacgtttccacgttcctccaacctacgtaccaacgccgtacgtcccgttaggccgtaacggttccgtacggtaaagtttacttttacggtactttaaattttacgttacttaggtacgtagtacgtaagttaactaacgtaacgttcgtaacccgttccgttaacttcggtttacggaccggtacgggtaaccaggtccggtaggtacggtaacgttacgaaaccgtagttcggtacggtctacgtccgtacttacg

SEQ ID NO: 69799 - DNA, 650 bp, Homo sapiens
  misc_feature: GYAE6OF02GX4GW.51.76.G10.1.454.CMB.1.raw
  modified_base (197)..(197): a, c, t, g, unknown or other
  misc_feature (197)..(197): n is a, c, g, or t
  modified_base (328)..(328): a, c, t, g, unknown or other
  misc_feature (328)..(328): n is a, c, g, or t
  modified_base (470)..(470): a, c, t, g, unknown or other
  misc_feature (470)..(470): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtgtctccgaggggaaancgccaccctctcctgcgagggccagtcagagtgttagcagcgacttagcctggtaccagacaagaacctggaccaggcctcccgaggcctcctcatctatgatgcactccaacgaacgggccactgatacncccagccctaggttcaggtcggctagggtcgggtcgtagggactaggtacgttaccacgtcctacaacctactaccacgtcacgtcctcgccgtagtacgtagtaacgttagtttacgtactttaaagttttacttacgttnttacgtagtaccgttaagttaacgttaaacttaacggtaccggttacccttaccggttactttaacgttttaccgggaccggtacggggaaccgtaacgggtacggtacgggtaacgtaacgttaaccgtaaacggtaacggttcggtaccgggtaccgtacggtaccctacgtaaccgg

SEQ ID NO: 69800 - DNA, 607 bp, Homo sapiens
  misc_feature: GYAE6OF02HQQDW.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgttagcagcgacttagcctaggtaccagacagaaacctggaccaggcctacccaggctcctcacttctatgatgacatccaacgacgggcctagtcgactactcccgagccgtaggttcaggtcgacgtgttgggtcgtgggactaggtacgttccacttctaccgaacataccacgtacacgtccgtagactagtctagtaagttacgttttagtacttaattttacgttaacgttcgtaccgtagtactaagttaactaacgttacgtcggtacccttaccgttaacttacgttttcggaccggtacgggtaccgtaagtcggtaggtacgtaacgtaaccgaaacgtacgttacggtgtaccgtacgacctacctacg

SEQ ID NO: 69801 - DNA, 859 bp, Homo sapiens
  misc_feature: GYAE6OF02G7MCZ.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacgagggggaggaactgctcagttaggacccagacggaaccatggaacgccccagcgcagcttctcttcctcctgctactctggctcccagataccactggagaagtagtgatgacgcagtctccagcccaccctgtctgtcgtcacgaggggaaanacgcctaccctcgtcctggcgacgggcccgagttccaggtacgttaggttacgacgacgaccggttaccttacggtccggttacgggtaaccacggaccgtaaacggtaaaacccgttcgggacccgtaacggcccgtttacccggacggacccttcctacgtacttccgtaattcggaacgttcacctactccaacggacggtaccactaggactacctaccgagaccgtacgttacgagttacggccgtaagggtgggtaccgtggggaaacctacggttacgtcccaccgtttaaccgccgtaaccccgtaagccgtaaccgccggtaaccggtcccgtaggtacccgttacgttaccggttaagggtaaaccggtttacgtttttaaccgggtaactttttaaacggttttttaaccttaaccggttacccgtaaggtaaacggttaacccgttaaagggtttaacctttaaaacggttaaccgttaccccgggttacccttacccgggtttaaactacccgggttttttacggaaccccggggtacggtaaccgggttaaccggacccggttaagtaaaccggttaaccgtaaaccgggtaaacgtttaaccggttcggtaaggtccccgtaacggtacctaaccgttacccgg

SEQ ID NO: 69802 - DNA, 559 bp, Homo sapiens
  misc_feature: GYAE6OF02GJTGN.51.76.G10.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttagcagcgacttagcctggtaccagcagaaacctggccaggctcccgaggctcctnatctatgatgcatccaagaacgggccacgtgaatatcccagcctaggttcagtggactacggtggtcgtagggacagtacgttcaccgtcncgaaccatcagacgacgccctgactaggttccagaacgttattttgacttaattttattactgtacacgtacagcgtaagcgttaacttcggccctaccgtcgattccaccgttacggaccgaaaggtaccacggtaacgtagggaagaacgttaaaccgtacgttaggtcggtacctggaaccc

SEQ ID NO: 69803 - DNA, 621 bp, Homo sapiens
  misc_feature: GYAE6OF02HCOF2.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtcctcgaggggaaanacgcccacccgtctcctgcgagggccagtcagagtgtagcagcgacttagccgtgaccagcaagaaacctggccacgggcctcccgaggcccttacctcattctagtgagtcgcactcccaacgaacgggccactgaactacgtacccacgtccgtagtttacgacggtggaccgtagggtcggggtctacggggaactaggtacgttccacgtcctacaccatcagaccgtacgcctgactagtctagtagttatttgtactttaatttacttacttgtccagtacgtaagttaataacttaacgttcgtaccgttaccgttacgttaccgtttacggacccggtacgggtaacgtacggtacggttacggaacgtaacgtaaccgtaacgtacggtggtaccgtacggtacgtacctacgtac

SEQ ID NO: 69804 - DNA, 727 bp, Homo sapiens
  misc_feature: GYAE6OF02H3OS0.51.76.G10.1.454.CMB.1.raw
  modified_base (194)..(194): a, c, t, g, unknown or other
  misc_feature (194)..(194): n is a, c, g, or t
  modified_base (332)..(332): a, c, t, g, unknown or other
  misc_feature (332)..(332): n is a, c, g, or t
  modified_base (433)..(433): a, c, t, g, unknown or other
  misc_feature (433)..(433): n is a, c, g, or t
tcagcgatcgtatacacgaccggtgctcgatttagtcactcatacagggggaggaactgctcagttaggacccagacggaaccatggagccccagcgcagctctcttcctcctgctactctggctcccagataccactggagaagtagtgatgacgcagtctccagcccacctgtctgtgtctccgaggggaanagccaccctctcctgcagggccagtcagagtgttagcagcgtattagccttaggtaccagcaagaaccgtggaccacggcctcccgaggtcctcctcagtctatcgatcgcactaccgacgaacggccagtgataccncccgagtccaggttcaggtgcgacggttggtcgtagggactaagggtcgttaccacttccgtacctaaccacgtacccgagtacccgacgtacccggttanaccgtacgttaccggtaggttaaagtttagtttttacggtaactttaattttaaccggtttaactacggtttaccgtaacgtacgtaaacgttttaacgttaaacgttaacccggttccgggtttaacccttcccggttttaaacctttaccgggttttttacccggggaaccggttaacccgggggtaacccttaacgggtccgttaaccggggtaagtaaacgttaaacccgtaaacgggttaaccgttccgggtaccggtttacggaacccgttaccgtacccgttaaccg

SEQ ID NO: 69805 - DNA, 602 bp, Homo sapiens
  misc_feature: GYAE6OF02H0508.51.76.G10.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (387)..(387): a, c, t, g, unknown or other
  misc_feature (387)..(387): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagtagtgttagcagcgacttagcctggtaccagcagaacctggccaggctcccaggcctccnatctatgatgcatccaacgtacgggccagtnatactcccgagcctaggttcagtgactggtggtcgtgggactagacgttccacgtcctcacgatccagtcnggtacctgaccaggtctaagtacgttatttagactttaatttattacgtctagtacgtactaagtaacttaaacgttaaccgtccggtaccttacccgttacttacggttttacggaaccggtacgggtaaccgtaacggtcgttacgggaactaaccgtaaccgtaaaaccggtacgttacggtaacggtaccgtcgtacccgtaacgtaaccg

SEQ ID NO: 69806 - DNA, 693 bp, Homo sapiens
  misc_feature: GYAE6OF02HL7J8.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagcccaccctctcctgcagggccagtcagagtgttagcagcgtacttacgccgtggtaccagcaacgaacctggaccaggcctcccgaggtcctcccgtacacttctagtgactcgactactacccaacggaacgggtcccaagtagtacttaacctccccgaagtcccgtaaggttccagggtcggtacgtaggggttcgggtcggtaggggactaagggtacgtttaccacgtcctaccaaccgtactccgaacgccgacgtccgtacgcgttacggtacgtaggtaagttagtttacgtactttaattttacgtttaacgtcgtacgtacgtacgtaagttaacttaaacgttaccggtaccgttacccttacccggttactttaccggtttaccggaccggtaacgggtacccgtaacggtacggtaacggaacgtaacggttaaccgtaaacgtacgttacgggtacggtccgtacggtacctaaccgtcg

SEQ ID NO: 69807 - DNA, 566 bp, Homo sapiens
  misc_feature: GYAE6OF02G2I7U.51.76.G10.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (360)..(360): a, c, t, g, unknown or other
  misc_feature (360)..(360): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctccagccaccctgtctgtgtctccaggggaaanagccaccctntcctgcagggccagtcagagtgttagcagcgacttagcctggtaccagcaagaaacctggccaggctcccaggctcctcatctatgatgcatccacgaagggccactgactactcccagccaggttcaggtcggacgaggtggtcgtgggganaggtagttcacgtctccaacactacacgcagccctgactagtctagaagttactttagacttaatttattacttgtactagtctaagttataaacttacgtacgtacccttaccgttacttacgtttaccggaccgtagggacctaaggtcgtaggtaacgtacgtaaccgaaacgtaccgtggtccggactacgacgtacctacg

SEQ ID NO: 69808 - DNA, 771 bp, Homo sapiens
  misc_feature: GYAE6OF02FJ7BB.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtcctccgaagggaancgccaccctctcctgcgagggccagtcagtagtgttagcaggctaacttagcctggtaccagcaagaacctggaccaggcctccgacggtctcctacacgttcctagtagtagtcgacctactacccgaacggtaacggggaccctaacggtacgaaccgtttacccgtacccgaacggtcccgttaacgggtttaccgaacgggtcggggtacgtaacggggttttcggggtaccgttaacgggggtaactaacgggtttaccgtttacccgaacccgtttaccgtaacccgaaccgttaacgttaccgaaccggtaccgtacgtcccgtacggtacgtaacggttaccgttaggtaaacgtttagttttaccgaacgtttaacgttttacgttacgtttacggtaaccgtaacgtacgttaacgttaactaaacgttaaccggttacggtaacccgtttacgtaaaccgttttacggtttaccgggaaccggttacggggaacctacggttaacggtacggtaacgtaccgtaacgaacgtcgttacggtacggtcgtacggacctacgtacg

SEQ ID NO: 69809 - DNA, 709 bp, Homo sapiens
  misc_feature: GYAE6OF02HZ5Z5.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtcgtctccgaaggggaaancgcccaccctctcctgcgacgggccagtcagagtgttagcagcgtacttgcctggtaccagcaacgaaccgtggaccaggcctcccgaggtcctcctacatcctatgtatgactactaccacggaacgggtcccaagtcgtactaccgtcccgacgtccgtacggttcgagggtcggacgtagggtcggggtcgtaggggtactaagggtacgtttcccacgtaccgtacccaacctacgtaccgacgtaccgtacgccgttacgtaccgtaacgttacgtacggttaacggtttaagtttacggtaacttttaaattttacgtttaacgttacgtacgtacgttacgttaagtttaaacttaaacgttaaccggttccgttaaccgtttacccgttaacgttaaccggttttacggacccggttacggggtaccgtaacggtacggtaggtaactaacgttaaccgtaaccggttacgttacggcggttaccgcggtacctacgtacg

SEQ ID NO: 69810 - DNA, 672 bp, Homo sapiens
  misc_feature: GYAE6OF02F0250.51.76.G10.1.454.CMB.1.raw
  modified_base (200)..(200): a, c, t, g, unknown or other
  misc_feature (200)..(200): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtcctccagccacctgtctgtgtcctccgaaggggaaancgcccacccttctcctgcgaccgggccagtcgaagtagttgtacgcgagacgtacttacgccgttacggtaccgacgacgaacgaaaccgtcggccgacggcctccccgacgtccttcctcactctagtgntcgacactaccgaacgacggactactagactacnccacgccgtacgtcgagtcggcgtaggtcgggtnacgggtanagtacttacgactcctactaaccctancgtacgcgtacgtcncgtacgtacgtcgttaaggtaactttagtttacgttacttaaacttttacgttaacttcgtaacgtacgttacgaaacgtttaacttaaacgtacttaccgttaccgttaaccgtttaccgttacgggtttaccggtaccggacgggtaccggtaacggtacggtacgaacgtaacggtaactaacggtacgttggtacccggtacgccttaaccgcgttacg

SEQ ID NO: 69811 - DNA, 719 bp, Homo sapiens
  misc_feature: GYAE6OF02GYAAT.51.76.G10.1.454.CMB.1.raw
  modified_base (530)..(530): a, c, t, g, unknown or other
  misc_feature (530)..(530): n is a, c, g, or t
  modified_base (559)..(559): a, c, t, g, unknown or other
  misc_feature (559)..(559): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagcgcccacccgtctcctgcacgggccagtcgagagtgttagcgacgcgtacgttacgcctggtaccagacaacgaaaccgtcggaccgacggcctccccgaaggtcccttcctaccgtacttaccgtatagtacgttcgacctacgtacccaacggaaccggggccacttacggacttaccgtaccccacggtcccgtagggttaccgaggttcggacgtagggttcgggtcgtacggggacgtaggttacgttaccgtacctaccgtaccaaccgtacgtacgacggtccaacggtcctgacctaggttcctaaggtaacgtttacgtttnaacgtttaatttaacttcgtacgtaacgngtaacgtaagttaataaacgttaaccgtcggttacccttaccggttaacttaccgtttacggggaacccgtacgggaacccgtaaggtccgttaacggaacgtaccctaaacggtaaaccgtacggttacgggtaccgtaccgtacgtaccctaacgtcg

SEQ ID NO: 69812 - DNA, 698 bp, Homo sapiens
  misc_feature: GYAE6OF02FLB7Q.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgttagcagcgacttagccgtcgtaccagccaagaaaccctgggacccagggcctccccgagggccttcccgtcattcctaagtcggattcgcacgtccgacgaacggccatcgacttacgtccagtccaggttcaggtcggcgtaggtcgggtcgtcgggactaggtacgttccactctacgacctagtacctacgccacggtccctgtaccgtacgttcgtaagtaacgtttagttttacgtactttaacttttaagtttaccgttacgttaccgtaagtacgttaagtttaacgttaacgttaaaccgttacgttacccgtttaacccgttaacgttaaccggtttttaccgggaccgttaaccggggtaacctaacgggttacggtaacgggtaaccggtaacgttaaccggtaaacgttaacggttcggttaccggacgtttaccggtacccgtaccgtttaaccg

SEQ ID NO: 69813 - DNA, 704 bp, Homo sapiens
  misc_feature: GYAE6OF02H97XD.51.76.G10.1.454.CMB.1.raw
  modified_base (197)..(197): a, c, t, g, unknown or other
  misc_feature (197)..(197): n is a, c, g, or t
  modified_base (542)..(542): a, c, t, g, unknown or other
  misc_feature (542)..(542): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacacagtctccagcccaccctgtctgtcgtctcgaggggaancgaccacctctcctgcgacgggcctagtacgagagttgttagcagaccgtacttacgccgttacggtaaccagtaccaaacggtaaaccgtcggggacccaagggcccctacccggaacggtcccttccgtactacttcttaagtacggtaatggacctactaccgaaacggaaccggggtacctaaccgtacgtaacctaccgtacccaccggtaccgtaacggttacgagggttcggacgtaggggttaccggggtcgtacggggacgtagtacggttaccaaccgttcctacctactactacgtacgacgtacgccgtacgactaggttactaggtaagttnttagttacttaactttacgttcgtacgtctagtagtacgtaataacgtaacgttcggtaccttaccggtacgttaaccgtttcggacgtacgggaaccgtaggtccgtaggtaacgtacgtaacgaaaccggttacgtacggtcgtacggctaccgactacg

SEQ ID NO: 69814 - DNA, 674 bp, Homo sapiens
  misc_feature: GYAE6OF02JYY1C.51.76.G10.1.454.CMB.1.raw
  modified_base (198)..(198): a, c, t, g, unknown or other
  misc_feature (198)..(198): n is a, c, g, or t
  modified_base (381)..(381): a, c, t, g, unknown or other
  misc_feature (381)..(381): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgctagtctccagccaccctgtctgtgtctccgaggggaaancgccaccctctcctgcagggccagtcagtagtcgtagcagtccgtattcgcctagggtaccagtcaacgaaccgtggccaggtcctacccgtaggcctccgtcaagttcctagtacgatcgacgtactaccgaacggaccggtccaacgtagtacctacgtacccgagtacccgtaggttacngggttcgcgtagggtcggtacgtggaactacgtacggttcacgttcacgtaccgagtcgcgaccgttacgcctcggtacgtagttaccgaggttaaacttcgtttcaacgtttaatttacgttacgtcgaacgtacgtacgttaagtacttaaacgtacgccggttaccttaaccggttcgttacggttaccggaccgggtaacgtaaccggtacgtcgggttaggaactaaccgttaaccggaaacggtaacccgtttgggtaccgtaccggacggtaccttacgttaccgg

SEQ ID NO: 69815 - DNA, 773 bp, Homo sapiens
  misc_feature: GYAE6OF02IUS6A.51.76.G10.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagcgatcgtatacacgaccggtgctcgatttagtcactcatacagggggaggaactgctcagttaggacccagacggaaccatggaagccccagcgcagcttctcttcctctgctactctggcctcccagactaccacgtggaagaagtagtgatgacgcagtctccagcctacctgtctgtgtctaccgaggggaaancgccacctctccngcgaggccagtcagagtgtagcagctattacgccgtaggtaccagacaacgtaaacctggacctacggcctacccgaggtcctacctacgaacttacgtagtggaatcgacctactaccgaacggaaccgggtacctaacgtagaaccgtaaccgtacccgacggtaccgtaaggtttaccgaaggtacgggacgtaacgggttcggggttaacgtacgggggtaaactaagggttaaccgtttaccaaccgttacctaccctaaccgtaacgttaccgaaacggcccgtaacgtcccggttagaaccgtaacgggttaccgtaaggtaaacggtttacgtttttaacggaacttttaaacgtttttaacgttacgtacgtaccgtaacggtaacgttaaagttaaagttaaaccgttaaccgttacgggttaacccttaccggttaacgttaaccgtttacgggaaccggtaacggggtaacctaacggtacggtaacggaaacttaacgtaaaccgaaacgttacggttggacgtaccgtacggtaccaccgttacg

SEQ ID NO: 69816 - DNA, 867 bp, Homo sapiens
  misc_feature: GYAE6OF02FYTQY.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtcctccagcccaccctgtctgtgtctccgaggggaaancgccaccctctcctgcgagggccagtcagtagtgttagcaggcgtacttagcctggtaccagtaccaagtaaaccctggaccgtacgggccttaccccgagggcccttcccgctaacttcttaacgtggtactcggaccacgtacccgaacggaaccgggggtcccaacggttaggaaccttaccgtccccgaacggtcccggtaacggtttacaacgggttcgggtaccgtaaggggtttacggggttaccgtcgggggtaaacctaaggggttaccgttttacccgtaacccgtttacccgtacctaacccgttaaccgtacggaacccggtaccggaacccgggtacccgttaggtaacccggtttaaccgggttaaccgttaacggggtaaacgttttaacggttttttacgtaaacccgttttaaaacgtttttttaacgttaacgtttacggtttacccgttaaaggtacttaaacgtttaaacgtttaaccgtttaaaaccggttcccgggtttaacccgttacccggttaaacctttcgggttttaaccggggtacccgggaacgggtaacccgtacggtacggttaacggaacgttaaccgtaaccgtaaacggttacgttacgggttaccggaccgttacggaccctacgttaaccgg

SEQ ID NO: 69817 - DNA, 750 bp, Homo sapiens
  misc_feature: GYAE6OF02J0MUT.51.76.G10.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (304)..(304): a, c, t, g, unknown or other
  misc_feature (304)..(304): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagttagtgatgacgcagtctccagccaccctgtctgtntctcgaggggaaanagccacctctctgcagggccagtcagagtgtacgcagcgacttagcctggtaccagcaacgaacctggccacggctacccgacggtcctcctccattcatcggtacncgtacctacttaccgaacgtaaaccggggcctaacgtagtaccttacgtaccccgaagtcccggtaacggttacgtacggggtcggtaaccgttagggttccgggttaccgttacgggaacgttaaccggggttactttaccccgacgttaccgttaaccctaacggttaactcccggaacgtaccggtacgtacccgttaggaaccggttacgtttaaaccgggtagttaacgtttacggttttacgacgttttaaattttaccgtaccgttagttaccgaacgttacgttaaacgttactttaaaacgtacgttcccgttaccttaacccgggtttaaacttccgggtttacgggcccgaacgggttaccgtacggtcgtaacgggtaataacccgtaacaaccgggttacgttcgtacgggtctaccggtaccctgtttaacc

SEQ ID NO: 69818 - DNA, 646 bp, Homo sapiens
  misc_feature: GYAE6OF02GUKYA.51.76.G10.1.454.CMB.1.raw
  modified_base (198)..(198): a, c, t, g, unknown or other
  misc_feature (198)..(198): n is a, c, g, or t
  modified_base (356)..(356): a, c, t, g, unknown or other
  misc_feature (356)..(356): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcagggccagtcagagtgttagcagcgacttagcctggtaccagcagaacctggccaggctccccaggcctcctctactctatgatgcatccacgaggccatgactactccagccgtaggttcaggtgcgaggtcgggtgtgganagtagtccgacgttctacgacctatacgacgcgacggtccttgctacggtcgtacgtaaggttattttacggtaacttaacgtttttacttaacgtttcgtacgtacggttacctaaggtttaaataaaccgttaaccgttaccgggttaccctttaaccggttacgtttaccggttttacgggacccgggtaaccggggtaccgaacgggttcgtaacgggtaacgtaaccgtaaccggtaaaccggtacggttcgggtagtacccggttacgaccgtaccttaccggg

SEQ ID NO: 69819 - DNA, 670 bp, Homo sapiens
  misc_feature: GYAE6OF02G7RFD.51.76.G10.1.454.CMB.1.raw
  modified_base (195)..(195): a, c, t, g, unknown or other
  misc_feature (195)..(195): n is a, c, g, or t
  modified_base (385)..(385): a, c, t, g, unknown or other
  misc_feature (385)..(385): n is a, c, g, or t
  modified_base (413)..(413): a, c, t, g, unknown or other
  misc_feature (413)..(413): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctcaggggaangccacctctcctgcagggccagtcagagtgtagcagcgacttgcctggtaccagcaacgaaaccgtggcccaggtcctacccgaggtcctcccgtacacttcctaagtcgactcggcactaccgaacggaacggaccctagtcgactaccgtacccacgccgtaggttcgacgtggacgtgggtggtcgngggtacagtacgtcactccaccactacncctacgctacgtccgtgacgtagtctaggtaacgtttagttttacactttaaacgttttacttacgtacgtaccgtaacgtacgttaaagttaacttaaacgttaccgttacccgggttacccgtttacccgtttaacgtttaaccgggtttcccggaaccgggtaccggggtaaacctacgggttacggtacgggaacgtaacggtaaccgtaaacgtacggttgggtaccgtacgtacgtacccgttaaccttcg

SEQ ID NO: 69820 - DNA, 701 bp, Homo sapiens
  misc_feature: GYAE6OF02HZTST.51.76.G10.1.454.CMB.1.raw
  modified_base (196)..(196): a, c, t, g, unknown or other
  misc_feature (196)..(196): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggagcccagcgcagcttctcttcctcctgctactctggctcccagataccactggagaagtagtgatgacgcagtctccagccaccctgtctgtcgtctccgaggggaaangcccacctctcctgcagggccagtcaggagtgttaagcaggcattagcctggtaccagcaagaaacctggaccaggcctcccaggcctccncgatctaatggactagctactaccacgaacgggccctaacgtggtaactactaccctaggtacccgtaacgggttccaagggtcggtacgtacgggtttcgggggtacctagggggaactaacgggtagttcctacgttcgtacccaaccgtactcgaacggtccagtcccgttcgacgtacgttacgtacggtaagtttaactttacggtaactttaaaacttttacgtttaacgtcggtacttaaggtaccgtaagtttaaacggttaaataaacccggtttcgggaccctttacccggttaaacgttaccgttttccgggaacggtacgggtaacctacggtacggtagggtaaactacgaaccgtaaaacccggtacgttcgggaccgacgtacggtaccccaacttcgg

SEQ ID NO: 69821 - DNA, 791 bp, Homo sapiens
  misc_feature: GYAE6OF02JFM0F.51.76.G10.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtcctccagcccaccctgtctgtgtctccgaggggaancgccaccctctcctgcgagggccagtcagngttgttacncacgcgtacttagcctaggaccagacacgaacctggacccaggtccctcccgaggtccctcctactaattctaatgtactgacctactaccaacggacggtacccaacgttgaactcccgttacccgacgtaccgtacgggtttacgacggtcgggcgtagggtttacggggttccggtacgggggtaacacgggttacggttaccctacccttccgtacccaaactacgttaccacgaccggttacgcccgtaggtacgtacgttaccgttaagtaaacggtttacgttttacgaaccttttaaagttttaacctttacgttaccgttaaccgtacgtaacgtttaacgttaaacgtttaaaccgttaaccggttcccgggttaccctttaacccgggttaaccgttttaccgtttacccggggaaccggttaacccggggttaaccggtaacgggtaacccgggttaggaaacgtttaacccggtaaaacgtaaacccgggttacgtttacggggacccggttacgtaccggtacccttaccggttacccg

SEQ ID NO: 69822 - DNA, 644 bp, Homo sapiens
  misc_feature: GYAE6OF02F97UO.51.76.G10.1.454.CMB.1.raw
  modified_base (196)..(196): a, c, t, g, unknown or other
  misc_feature (196)..(196): n is a, c, g, or t
  modified_base (394)..(394): a, c, t, g, unknown or other
  misc_feature (394)..(394): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccgaggggaagngccaccctctcctgcagggccagtcagtagtgttagcagcgacttagcctggtaccagccacgaaacctcggccaggcctccccgaggtcctccgtacacttccgtagtgatcggacctactacccgaacgaacggggcccaagtacgaactaccgtcccgagtcccgtaaggttcaggtcggacgtaggtcggtcgngggactaggtacgttccacgttcctacgacctacgtacgacgaccgacgtccgtcgacgtacgttcgtaacggtaagttacttttacggaacctttaaagttttacttaacgttcgtaccgtaagtactaagttaacttaacgttaacgttacgtcccttaccgttacgttacgtttcggaccggtacggacacggtacgtagaagtacgtacgaacgtacgttcggtacggtcgtcgtaccgtactacg

SEQ ID NO: 69823 - DNA, 740 bp, Homo sapiens
  misc_feature: GYAE6OF02HX2IB.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgttgtctccgaggggaaancgcccaccctctccgtgcgacgggccagtcagtagtgttagcagccgtacgttcgctggtaccagctaaacgaacctgggaccaggcctacccgaggccttcctctatctagtcgatcgactacgtccaacgtaacggccctagtacgaacgtacctcccgaaggtccgtaaacggttccgaagggttcggaccggttagggttacgggtcggtacggggtaactaagtacggtttccaacgttcctaaccgtaccgtaacgtacccgaaagtccggtaacgtccgtacgacgtaacgttccgtaaggtaagtttaacgtttcgtaacgttaattttaacgttaacttcggtaacgtacgtaacgtaaagttaaccgtaaagttaaccgttccggttaacccgttaccggttaacgtttacccggtttaccgggacccggttaaccggggtaaccttaacgggtaccgtaggtaaacgtaacgtaaccgaaaaccgttaccggttacggtaccggttacctacggtaccctacgttaacccg

SEQ ID NO: 69824 - DNA, 672 bp, Homo sapiens
  misc_feature: GYAE6OF02IEZPM.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagactaccactggagaagttagtgatgacgcagtctccagcccacctgtctggtcgtcgtaccgaggggaaagacgccctaccctctcctcggcagggcctagtccaggtagttagttacgcgacggcggtacttacgcctaggtaccagacgaacggtaaccgtgggaccacggccgtacccgaacggtccttcccgactacttacgtatgagtcgtacctacgtaccaacgaacggaccacgtacgactactcccgaagccgtaagttccgagtcggacgaggttcggtagtacgggacgtaagtacgtcactactacgtacctagtcgacgctacgtccgtacgtcgtacgtactacggaagttcgtttacgaacttaatttacttaagttcgtaccgtagtaccgttaagtacttaaacgtaccgttacgtacccgttacgttaaccgttcgtttacgggaccgtacgggtacgtaacgcggttaacggactaacgtaacgtacgtaacgtcggacgtacggtacgtacgtacttaccg

SEQ ID NO: 69825 - DNA, 608 bp, Homo sapiens
  misc_feature: GYAE6OF02F77YU.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcgacgggccagtcagagtgttagcagcgtacttagcctggtaccagcaagaaacctggccaggcctcccgaggctcctcactctatgtatgctactaccacgaacggccaactagactacctacccgagtccgtaggttcaggtcggcgtaggtcggtcgtgggactagtacgtccactctacacactcgacgcgacgtccgtagacctagtctaaggtattacgtttagaactttaatttacttcgttacgtcaagtacgtaagttaacgtaacgttaccgtcggttacccttaccgtacgtttacggtttcgggaaccgtacgggtaactacggtcgtaggaacgtacgttaaccgaaacgtcgttaggtcggtactcggtacccacgttacg

SEQ ID NO: 69826 - DNA, 817 bp, Homo sapiens
  misc_feature: GYAE6OF02FOPRR.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaanagccaccctctcctgcagggccagtcagagtgttagcagcgacttagccgttggtaccagacgaacgaaacccgtggaccgaggccttaccccgaggtccttcctcacttctatgatcgacctacgtaccgaacgaacggggaccctaacgtacgtaacttacctaccccgagtacccggtaaggtttccgacggggtttcggacggttaacggggttcggggttaccggttaacgggggaaccttaacggggtaacgtttccgtaacccgttacccgttaaccaacccgtaacgtaccgaacgaccgtaccgtcccgttacggaacccgtacggttaccggttaaacggtaacgtttaacggtttttacggtaaccttttaaacggtttttaagttaacccgtttacgtacgtaaccggttattaaacggttaactttaaacgtttaaccgtccggtttaaccccgttacccgtttaaccggttaccgttttaccgggtaaccggtaccggggtaacccgttaacgggtccgggtaacggggtaacgttaaaccgtaaccggtaaaacccggttacgtttacgggaccggttaaccggtaccgtacccgtaaccgttaccg

SEQ ID NO: 69827 - DNA, 680 bp, Homo sapiens
  misc_feature: GYAE6OF02FFZKO.51.76.G10.1.454.CMB.1.raw
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtgtgatgacgcagtctccagccaccctgtctgtgtctccgaggggaancgccaccctntcctgcgacgggccagtcagtagtgttagcagcgtacttagcctaggtacccagctaacgaaaccgtggacctacggcctaccccgaggtcctaccctcacgttctaatgacttcgctactccgaagaacgggcctagttagacttactacccgacgtcctaggttaccaggtcggacgtagggtcgggtacgtcggggaactaggtacgttacaccgttctacgacctagtaccgagtacgacgtccgtcgacgtacgttacgaagtacgtttagtttacgacgtttaaattttacgttacgtcggtaactacgttacgtaagttaacgttaacgttaaacggtcccggttacccgttaccttaaccgtttacgtttacgggacccgttacgggaacctacggtaacggtcggtaaacgtacctaacggaaacggttacgttcgggtaccgtgtacccggacctacgttaaccg

SEQ ID NO: 69828 - DNA, 749 bp, Homo sapiens
  misc_feature: GYAE6OF02IXL5S.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactgggagaagtagtgatgacgcagtctccagcccacctgtctgtcgtctaccggaaggggaaagacgcccaccctctccgtgaccgacgggccagtcaggtaggttgtagcacggacgtacttacgccgtaggtaccagacaacgaaaccgtggaccgaggtcctacccgaacggccttccctcgtaacttacctaagtcggtaatcggacctaacctacccgaaccggaacggggaccctaacgttacgtaacttacctacccgacgtacccgtaaggttaccgagggtcggacgtaggggttcgggttacgtaggggtaacaggtacgtttaccctacgttccgtaccaccgtacgtacaacgcgaacgtccgtcacgtacgttacgtacggtaagttactttacggtaactttaagttttaacgttaacgttcgtacgtacgtacgttaaggttaaactaaacgttaccgttacggtacccgtttaccgttaactttaacgggttttaccggacgggtaaccgggtaacctaacgggtacgtagggtaacgtaacgtaaccgtaaacggtaacgttacggtaccgtacgtacggtactacccgttacg

SEQ ID NO: 69829 - DNA, 583 bp, Homo sapiens
  misc_feature: GYAE6OF02F8T2W.51.76.G10.1.454.CMB.1.raw
  modified_base (197)..(197): a, c, t, g, unknown or other
  misc_feature (197)..(197): n is a, c, g, or t
  modified_base (291)..(291): a, c, t, g, unknown or other
  misc_feature (291)..(291): n is a, c, g, or t
  modified_base (407)..(407): a, c, t, g, unknown or other
  misc_feature (407)..(407): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttagcagcgacttagcctggtaccagcagaaacctggccaggctcccgaggctcctcatctangatgcatccacaaggccatgatactcccagcctaggttcaggtcggcgaggtcgggtctagggacaggtacgttcacgttcctacacctatcagcacgcctgcagtctagaagttntttagacttaattttacttactgtacagtactagttaataaattaaccgtcgggttacccttaccgttacttacgttttccgggaccgtacggggaccaacgggtccgtaagggaacgtaacgtaacccgtaaaacggtacgttagggtacggtactacggaccctaaccgttacg

SEQ ID NO: 69830 - DNA, 753 bp, Homo sapiens
  misc_feature: GYAE6OF02HV7HZ.51.76.G10.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
tcagcgatcgtatacacgaccggtgctcgatttagtcactcatacagggggaggaactgctcagttaggacccagacggaaccatggaagccccagcgcagcttctcttcctctgctactctggcctccagataccactggagaagtgtgatgacgcagtctccagcccaccctgtctggtgtcctaccgaaggggaaanaccgcccaccctctccgngcacgggccagtcgagtagttgtaacgcagtcgtacttacggccgtacggtaccaacgacgaaacgtaaccggtcggaccgtacggccctaccgacggtccctcctacgattcctagtcgactacgcactccgaaggaaccggcctaagtacgtactaccgtacccgagtaccgtacggtacgtaaggtcgggtcgttacggggtcgggtacgttacgggggacttaacgggtactttcccgtaaccgttcgtaacccggacctacgttccgacgtaccgtaaccggtccgtacgtaccgttacggtaccgttaaggtaacgtttacgtttaacgttaacgtttaaagtttaccgtttaacgttgtaaccggttactacggtttaaacttaacgtaacgtttccgtaaccgtttccgttacccgtaaagtttcggttaaccggtccggaacgggtaccgtacgggtacggtacggttaacgaaccgttaccgaaacggtcgttacgggtacgtacggttacgacgtaaccttcgg

SEQ ID NO: 69831 - DNA, 633 bp, Homo sapiens
  misc_feature: GYAE6OF02JAJ5C.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaanagccaccctctcctgcagggccagtcagagtgttagcagcgacttagcctaggtaccagcagaaacctggccaggcctccccgaggcctccgtcactctagtgagtcgacgataccacgaacggggccaacgtgatactcccacggtccaggtttcaggtcggcgaggttcgggtcgtgggactaggtacgttcacctccgttacacctacgtctacgcgtacgccgtggtactagtacgtgtagttacgttttgtacttaatttacttacttcgtacgagtcagttaactaaacttacgttaccgtacccgtttacgttaccgtttaccgttttacgggaacccgtacggggtacccgtaggtccggttaacgggtacgtaaccgtaaccgtaaacggtacgttacggtcggtaccgtcggtacccgtacttaccgg

SEQ ID NO: 69832 - DNA, 728 bp, Homo sapiens
  misc_feature: GYAE6OF02G2SW4.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtcctccgaggggaaancgcccaccctctcctgcagggccagtcagtagtgttagctagacgtacttagcctaggtaccagcaagaaacctggaccacggtcctacccgacggccttacccgtacactacttatcgtatcgactactccaacggtacggaccactagactaccgtacccacgtccgtaacggttcaggttggccgtagggtttcgggtacgtaggggtaactacggttacgtacctacgtacccgtactaaccacgttacacggtccgaacgtcccgttggacctttaacgggttcctaaagggtaacgtttacgttttaacggaaactttaacgtttttaagtaaccgttactaacggacgttaacgttaaacgtttaacgtaaacgtttaccggtaccgttacccttaaccggttacctttaacggtttccggaaccgggtaacggtacccgtaaagttcggtaacggggtaactaaccggtaaaccgtaaaccggtaggttcggtaaccgtccgtacggacccttacgttacg

SEQ ID NO: 69833 - DNA, 761 bp, Homo sapiens
  misc_feature: GYAE6OF02H2JO5.51.76.G10.1.454.CMB.1.raw
  modified_base (203)..(203): a, c, t, g, unknown or other
  misc_feature (203)..(203): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggctcccagactaccactggaagaagtagtgatgacgcagtcctcacgccacctgtctgtcgtcctaccgaaggggaanacgcccaccctctcctgcgacgggcacgtcagagttgtagcagtactacgttacgccttcgggtaaccagcgaaacgtaaccgcggacccgaggtccctaccccgaggtccctccgtacctattacgttatacggtactcgaccctaacgtaccgaaaccggaacgggtccctaacgtacgtaacctaccctacccgaggtcccgtaggtttacgcgggttacggcggtacgggtttgggtcggtagggacgtacggttcgtttaccaccctttcctaaccgtaccctaggacctaccgggtaccgtacggtcccgtacggtacgtacgtttagggtaaatttaaccgggtttaatttttccgtaaacggttttaaatttttacccggttaaactttggtacgtaagttaaccgttaaagttaacttaaccgtaccgttcgtacccgttacgttaccggtttacggttacggccgggttaacgcctaagggtcgtaaccggtagtaaccttaacgtaaccgttacggcggtttccggactacccgtacgaccggtttc

SEQ ID NO: 69834 - DNA, 872 bp, Homo sapiens
  misc_feature: GYAE6OF02G9GVJ.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtcctccagcccacccttgtctgtgtcctcgaaggggaanacgccctaccctctcctgcgacgggccagtcgagtagtgttacgcgagcgtacgttacgccgttaggtaccagacaacgtaaccgtcggaccacggtcccctacccggacggtccctaccctcctaacgttccgtagttacgacgtccgacaaccgtaccccggaacgtaacgggaccccttaaggtacgtaacctacccgtccccggaacgttcccggtaacggtttaccgaacggggttccggtccggttaaggggtttcggggtacggtacggggaactagtacggtttactacccttacctaccgtaacctacgtacgacgtaccgacgtccgttagccgttacgttacgtaacgggttaatttacggtttaaccgtaacttttaaacgtttttaccgtaaccgtttggtaaccttaacggtaaccgttaaacgttttaaaccgtttaaaccgtttaaccgttacccgggtttaaacccgtttaaccccgggttttaaacgtttaacccgggttttaccggggaacccggggtttaacccgggtaaacccggttacgggttaaaccggttaccgggttaaaccgaaacccggtttaaacccggttaaacgttaaccgggtttccggtaaacgggtccccgtttaacggtacccgtacccgttaccgg

SEQ ID NO: 69835 - DNA, 616 bp, Homo sapiens
  misc_feature: GYAE6OF02INPZF.51.76.G10.1.454.CMB.1.raw
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttagcagcgacttagcctggtaccagcagaacctggccaggcctccaggctccanatctatgatgcataccaacgaacggccaacgtgaactactcccgagcctaggttacaaggtggactagggttgggtcgtagggactaggtacgttcacgttcctacaacctagtacacgtcgagtccgtgactagtatacgaagttactttcgaacttaattttaacgtacgtgttacgacgtacgtaagttaataaacgtaacgtacgtcccttaacggttaaccttacgttttccgggaccggtacggggaaccctaaggtccgttagggtaacgtaacgttaacgaaaaccgtacggttcggttacggacctacggtcccaacgtacg

SEQ ID NO: 69836 - DNA, 593 bp, Homo sapiens
  misc_feature: GYAE6OF02ITCLT.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccacccctctcctgcagggccagtcagagtgttagcagcgacttagcctggtaccagcagaaacctggccaggcctcccaggctcctcatctatgatgcactccaacgaacgggccactgactatcccagcctaggttcagtggctaggtggtacgtgggacagacgttcactctcaccatacagcacgcctgctacgtctacggtaagttattttgtacttaattttacttacgttacgtacgtagactaagttaattaaacttaacgtcggtaccctttaccggttaaccgtttaccgttttacgggacccgtacggggtaacctaacgggtcgttaggaacgtaactaaccgtaaacgtacgttcggtacggtctacgtacctacgtacg

SEQ ID NO: 69837 - DNA, 558 bp, Homo sapiens
  misc_feature: GYAE6OF02JC4DL.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccacctctcctgcagggccagtcagagtgttagcagcgacttagcctggtaccagcagaacctggccaggctcccgaggctcctcatctatgatgcactccaacgagggccacgtgatacgtcccagccaggttcagtcggctaggtcggtcgtgggacagtagttcacctcgtacactactcgagcacgcctgcagtctagaagttcgtttagacttaatttattacgtcgtacagtacaacgttactaaacgtacgtacgtaccttaccgtacttacgtttacgggaccgtacgggtaacccaggtcgtaggtagtactacgaaacgtacgtcgtacggtctacgaccgtacgtacg

SEQ ID NO: 69838 - DNA, 653 bp, Homo sapiens
  misc_feature: GYAE6OF02GVV6C.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggaagaagtagtgatgacgcagtctccagccaccctgtctgtgtctccgaggggaaanacgccaccctctcctgcgacgggccagtcagtagtgttagcagcgtacttagcctggtaccagcaagaaccgtggaccaggcctcccgaggcctccgtacactactagtcgatcgcactaccgaacgaacgggccaacgtgtaactactacccgagccgttaggttcaggtcgacgtagggttcgggtctacggggactaggtacttaccgtacctcctacgacctatacgtacgctacggtcctagacctagtaccgtagtaaacgttgttttacgtactttaaattttacttacgttacgtacgtacgtacgttaattaacgtaaacgttaccgtcgttacccgtttaccttacggtttaaccgttttaccggaaccggtacgggtactaggtacggtaagtacgtaacttaacgaaggttacgtcggtacgtacgtacgtacccgtagtacg

SEQ ID NO: 69839 - DNA, 848 bp, Homo sapiens
  misc_feature: GYAE6OF02GOHW5.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggcctcccagataccactggaagaagtagtgatgacgcagtcctccacgacccacccttgtctgtgtccgtacgaaggggaaacacgcccaccctctccgtgccgacgggacctaggtcgaggtagttacgttacgcgacgccgtaacgttacggcccgttacggtaccaaggaccgaacgaaacccgtcggacccgtaacggcccgtacccgacgggtcccttaccctaccgtaactaccttagtacggtattaccgcctaaccgtacccgaacggaacccgggtacccctaaacgttacgtaaaccgttccccgtaaaccccggtacggtacccggttaacgggtttaccacggggtttaccgggtaccggttagggggtttcggggtaccggtaagggggaaaccgttaacgggttaccgttttaaccccgggtacccttaacccggttaaccctaacccggttacgtaacccggtaaccgggtacccgaaccgggtacccggttacggtaacccgttaacggttaccgttaaacggtttaacgtttaacgttttacgtaaaccgttttaacgtttacttacgttacgtacgtaacggtactaacggtacgtaacgtacttaccgttccgtcccgtacctctaccgtaccgtaccgtaccggtacggaacggtacgacgtagaacgtaacgtaactaccggtaatcggtacgacgtctaccg

SEQ ID NO: 69840 - DNA, 753 bp, Homo sapiens
  misc_feature: GYAE6OF02H8Z9H.51.76.G10.1.454.CMB.1.raw
  modified_base (188)..(188): a, c, t, g, unknown or other
  misc_feature (188)..(188): n is a, c, g, or t
  modified_base (199)..(199): a, c, t, g, unknown or other
  misc_feature (199)..(199): n is a, c, g, or t
tcagcgatcgtatacacgaccggtgctcgatttagtcactcatacaggggaggaacgtgctcagttaggacccagacggaaccatggaagccccagcgcagcttctcttcctcctgctactctggctcccagataccgactggagaagtagtgatcgacgcagtctccagcccaccctgtctgtgtcnccgaggggaanagcccaccctctcctgcacggccagtcagagtgtagcgagcgacttacgccgttaggtaccagaccaagaaacccgtggacccaggcctacccgagcccttcctactacgttcctaagttcgacgtcgacctactacccgaacgtaacgggacccaacgtacggtaacttacctcccgaacggtcccgtaacgggtttaccgagggttacgggaccgttaaggggtttacgggttacctaacgggggttaccctaaggggttaacctttaacccgaccgtttacccttaccgaaacccgtacgttaaccctaacggtacccgtaacggtcccgttacggtaaccgttacggttaaccggtttaacgttaaggtttaacgttttaacggtaactttaaacgttttaacgttacgtttacgtaccgtaacgtacgtaacgttaacgtaacgttaacgtcgtacccgttacgtaccgttacgtttacgacgtacggtaccgagtcgaggtagtaacgtaccgtaaacgacgttaggtccgtactacgtacacctacg

SEQ ID NO: 69841 - DNA, 734 bp, Homo sapiens
  misc_feature: GYAE6OF02FQCRB.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggaangccaccctctcctgcgagggccagtcagagtgttagcagccgtacttagcccgtggtaccagccaagaaacctgggacccaggcctacccgaggcctccctcatcctagtcgatgctactccaacgacggccatgtactactcccagcccgtaggtttcaggttcggctacggggttgggtacgtagggactaggtacgttacccacttccgtaccaccctagttaccacgaccacgtcccttagcgtacgttcgtaagggttaagtttacgtttttacggaacttttaaacgtttttaacgtttacgttacgttaaccgaccggttattaaacgggtttaaattaaaaccgtttaaccggttccgggttaacccccgtttacccggtttaacctttaacccggtttttcgggggaaccccgtacggggggtaaaccctaacgggtccgtttaacggggacgttaaaccgtttaaacccggaaaccgttacccggtttacgggtaccggttctaaccgggtacccctaaggttaacccg

SEQ ID NO: 69842 - DNA, 654 bp, Homo sapiens
  misc_feature: GYAE6OF02HPTQI.51.76.G10.1.454.CMB.1.raw
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagngcccaccctctcctgcgagggccagtcagagtgttagcagcgacttagcctggtaccagcacgaaacctggcccaggcctcccgaggcctcctacacttctangtatgacactccaacgaacgggccaactgactactcccagcctaggtcaggtggactagggtgggtcgtagggacgtacgtacgttcactccgtcaacctactacacgcacgcctgctagtcgtaagtaacgtttacgtttacgtacttaaacgtttttactacgttacgtacgtacgtacttaacggttaaacttaacgttaaccggttacgttacccgtttacccgtttaaacgttaaccggtttttacgggacccggtaacgggggtaccctaaacgggtcgtagggaaacgtaaccgtaaccgaaacggtacgttaggtaccggtaccgtacgacccgtacgttaaccg

SEQ ID NO: 69843 - DNA, 856 bp, Homo sapiens
  misc_feature: GYAE6OF02IYLLX.51.76.G10.1.454.CMB.1.raw
tcagcgatcgtatacacgaccggtgctcgatttagtcactcatacaggggaggaactgctcagttaggacccagacggaaccatggaagcccagcgcagcttctcttcctcctgctactctggctcccagactaccactggagaagtagtgatgacgcagtctccagccacctgtctgtgtctcgagggaaagcgccacctctcctgcagggccagtcagtactgttagctagcgtacttagctggtaccaggcacgaaacctggacctacggcctacccgaggtcctcctacgtactctagtcgactggacctacttaccaacgtaacggggaccctaacgtcgtaacctacgtacccgtaacgtacccgtaacggttcccgagggtacgggtcgtaacgggtttcggggttcgtaacggggtactaagggtaaccggtttactaacccgttaccgtaaccgtaacccgtacggttaaccaaccgggtacccgttaacggtccccgttaggtaccgttaacggttaacgttaacggggttaaaacggttaacccggttttttagggaaacccgttttaaaacggtttttactttaacccgggttacggttaaacgttaaccgggtacctttaaaaggtttaaccgttaaaaccggtttaacggtttaacccgggtaccccgtttttaacccggttaaacccgttttaaccgggtttttaccggggtaacccgggttaaaccggggttaaccttaacccgggttaacgttaaccggggttaacgtaaccggtaaaccggtaaacggttaccgttacgggtaacccggttaccgacggttacccgtaccgttaacgg

SEQ ID NO: 69844 - DNA, 622 bp, Homo sapiens
  misc_feature: GYAE6OF02FHFMT.51.76.G10.1.454.CMB.1.raw
  modified_base (198)..(198): a, c, t, g, unknown or other
  misc_feature (198)..(198): n is a, c, g, or t
  modified_base (430)..(430): a, c, t, g, unknown or other
  misc_feature (430)..(430): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtaatgacgcagtctccagcccaccctgtctgtgtctccgaggggaaancgcccaccctctcctgcagggcccagtcagagtgttacgctagcgactttacgccttgggtaccagcaacgaaccctgggccaggcctcccgaggcctcctcattcgtatgatcgcactccaacgaacgggtcccatgaactactccccgagcccgtaggtttcgaggtggcctagggttcgggtcgtaggggacacggtacgtttccaccttcgtaccacctactcacgcncgtcctgacctacgttctaaggtaacgtattttacgacttaattttacgttacctgttcagtactaagttaataaaccgtaacgttcggtacctttaccgtactttaccggtttacgaccggtaacgggaccacggtccgtaggacgtacgtaaccgaaacgtacgtggtcgccgtacgacctacctgttcg

SEQ ID NO: 69845 - DNA, 808 bp, Homo sapiens
  misc_feature: GYAE6OF02FNVDY.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccaccctgtcctgtcgtctccgaggggaanacgcctaccctctcctcgcgacgggccacgtcgagtacgttcgttagcacggcgacgtttacgccgttaggtacccacggacgaaacggtaaacccgtggacccgaagggccccgttaccccgacgggtcccttcccgtacgtacgttaccgtaagtacggtacgttcggtactaccgttaccgtaaccggtaacggggtccccaacgttcggaacctttaccgacccgaacggtcccgtaaggtttccgaacggtcgggtacgtacggggttcgggtaccgtgggaaccgtaaggtaacggtttccaaaccgtttccgtaaccctaacgtaccgttacgaacggtaccgaccggttccgagtaccgttaacggttacttaagggtaacgtttacggtttttacggtaaccttttaaagttttacctttacgttacggtcctaaggtacttaaacgttaacttaacgttacggttacgttaccctttacgttaaccgtttacccgtttagggtacccggtaaacgggccgttaacggtcggttaacggagttaaccggtaacgtaaccggtaacgttgggtaaccggtactacggtacccgaacgttaccg

SEQ ID NO: 69846 - DNA, 543 bp, Homo sapiens
  misc_feature: GYAE6OF02I05K5.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (253)..(253): a, c, t, g, unknown or other
  misc_feature (253)..(253): n is a, c, g, or t
  modified_base (523)..(523): a, c, t, g, unknown or other
  misc_feature (523)..(523): n is a, c, g, or t
  modified_base (538)..(538): a, c, t, g, unknown or other
  misc_feature (538)..(538): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctntcctgcagggccagtcagagtgttagcagcgacttagcctggtaccngcagaacctggccaggcctcccaggctcctcatctatgatgcatccacaagggccactgatactcccagccaggttccaagtcggacaggtgggtctgggacaggtacgttcacgtctacgacctatcagcacgcctgactagtctagaacgttattttgacttaatttacttactagtctagtactaagttaataactacgtcggtacccttacgtacttacgtttggaccgtacggggaccaagtcgtaggacgtaatacgaacgtancggtacgctgtaccnctacg

SEQ ID NO: 69847 - DNA, 808 bp, Homo sapiens
  misc_feature: GYAE6OF02G8NGC.51.76.G10.1.454.CMB.1.raw
tcagcgatcgtatacacgaccggtgctcgatttagtcactcatacagggggaggaactgctcagttaggaccccagacggaaccatggaacgccccagcgcagcttctcttcctcctgctactctggcctcccagactaccacgtggagaagtagtgatgacgcagtcctccacgcccaccctgtctgtctcctcgaaggggaacacgcccaccctctcctcgcgacgggccagtcagtagtgttacgcgagcgtacttagcctaggtacccagacaacggtaaaccgtcggacccgacgggtcccctaccccggaggtacccttccccgtactaacgtttcccgttaacgtcggtaaccgttcggacccttaaccgtaccccggaaaaccggggaaccggggtaccccctaacgggtactaaccttaacccgtccccggaacgtacccggttaggtttaccgagggtcggtaccgtaggggtttcgggtcgtacggggaactacgggttccttaccaccggtccttaacccaaccgtacgtaccgaccgtaccgaccggtacccggtcgtacgtaccggttaacgttacggttaagtttacgtttttaacgttaaccgtttaaacgtttttaaccgttaccgttacgtaacgtaccggttagttaaacgttaaacgttaaactaccggttccgtacccgtttaccgttacgttaccggtttacgaccgggtaccggtaacgacgtcggaagtacgtaccgtaactaacgttacggtacggtccgtaccggtcctaccgtacttacgg

SEQ ID NO: 69848 - DNA, 621 bp, Homo sapiens
  misc_feature: GYAE6OF02HLC2L.51.76.G10.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagagtgtagcagcgtacttagcctggtaccagcaagaaacctggccaggcctccgaggcctccncatcctatgatgcactccaacgaagggccactgaactactacccgacgccgtaaggttcacggttggcgtaagggtcgggttcgtaggggaacctaaggtacttccgacttccgtacacctactcgagtcacgcctgacgagttacgtagtaagttatttcgacttaattttattactgtacacgtagtaagtaattaacgtaacgtcgttacccgttaccgttaacttaaccgttttccggaccggtacggggtaacctacgggtacgtacgggtaactaacgtaaccgaaaacgtacgttacggtcggtaccgtacgtaccgaaccttacgg

SEQ ID NO: 69849 - DNA, 795 bp, Homo sapiens
  misc_feature: GYAE6OF02H4AXO.51.76.G10.1.454.CMB.1.raw
  modified_base (314)..(314): a, c, t, g, unknown or other
  misc_feature (314)..(314): n is a, c, g, or t
tcagcgatcgtatacacgaccggtgctcgatttagtcactcatacagggggaggaactgctcagttaggaccagacggaaccatggaagccccagcgcagcttctcttcctcctgctactctggctcccagataccactggagaagtagtgatgacgcagtctccagcccacctgtctgtgtctccagggggaatgccacctctacctgccagggccagtcagagtgttacgcaaggctactgccttaggtaccagactaacgaaaccgtcggacctagggcctacccgaacggccttacctcgtattaccgtntaccggtattaggacctacgttaccacggaaacgggtcctaactgtacgttaaccaccgaacggttacccgacggtttaccgaggttaacgggttccggtaaagggttttccggggtactacgggggtaacctaagggtttacggttaaccctaccgttcctttaacccgaacccgtacgttaccgaacggtaccgtaaccggtacccgtacggtaaccgttaaccgttcggtaaccggtttaaggttttaaccggtttttaccgttaaaccgttttaaacgtttttaccgttaacgttaccggtttaaccggaacgttaacgtttaaacggttaacgttaaacgtttaacccgtcggttacccttaccggttacgtttaccgttttacggacccggtaacgggtacctacgggtacgtacggtacggtagttaaccgaacggttacgtcggttaccgtacgtacgtaccgtaccggttac

SEQ ID NO: 69850 - DNA, 690 bp, Homo sapiens
  misc_feature: GYAE6OF02HM3X1.51.76.G10.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (259)..(259): a, c, t, g, unknown or other
  misc_feature (259)..(259): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgctagtctccagccaccctgtctgtgtctccgaggggaaancgccaccctntcctgcgagggccagtcagtagttgtagcagcgacttagccgtggtaaccngcaacgaaactggccaaggtcctacccgaggtaccttccgtacaacgtcttatcgagtcgtacctactcccaacgaaacggggccctaacgtggtaactacgttacccgacgacctaaggtttaccaggtacggctaggttacggggtacgtgggaacctaggtaacgttcaccttcgtccaacgtatacgacgtcgaacgcctgtacacgtacgtacgtaagttacgtttacgtaacttaattttaacgttaacttgtaccgtagtacgtaattaaacgtaaacttaacgtacggtaccgttaccggttaaccgttaccgttttacggaccggtacgggtaccgtaacggtaacggttacggtaaggaacttaaaccggtaaaaccgtacgttaccggtacggtaccgttaccggtaccgtacctaaccg

SEQ ID NO: 69851 - DNA, 760 bp, Homo sapiens
  misc_feature: GYAE6OF02GPPIF.51.76.G10.1.454.CMB.1.raw
  modified_base (237)..(237): a, c, t, g, unknown or other
  misc_feature (237)..(237): n is a, c, g, or t
  modified_base (556)..(556): a, c, t, g, unknown or other
  misc_feature (556)..(556): n is a, c, g, or t
tcagcgatcgtatacacgaccggtgctcgatttagtcactcatacagggggaggaactgctcagttaggacccagacggaaccatggaagccccagcgcagcttctcttcctcctgccttactctcggcctcccagtactaccactggagaagtagtgatgacgctagtctccacgcccacctcgtcttgtacgttcctccggaagggggaaacacgcccctacccctccttcccgnggccctacgggcccaaggtcaacgggtagttagttaggaccgtacgaccggtaaaccttcggccccgttacgggtaacccgaagtaccgaaacggtaaaacccgtcgggaacccaacggggccccttaccccggaccggtccttccctacgtaacctcgttaacgtcgtacgtcgacctacgtaaccccaaggtaaccgggtccctaaattcgtaccttaacccgccccaaggtccgtacggtttcgaacggtcgccggtacgggttggggaccttaggggtaccaaggtttcgtcaccgtctacccaagtaccgtacncggtacacgtccgtacgcgtactacggtaagtacgttacgttagtactttattacttacgttatcgactacgtaagttaactaacgttaactaccgttaccgtaccgtaccgtttccggttacgaccggtacgggaccgtacgtcggtaagtacgtacgtaaaccgtaacgagtaccgtagtaccgtacgtaccaccgttaccg

SEQ ID NO: 69852 - DNA, 770 bp, Homo sapiens
  misc_feature: GYAE6OF02FHJYR.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacgagggggaggaactgctcagttaggacccagacggaaccatgggaagccccagcgcagcttctcttcctcctgctactctggctcccagataccactggagaagtagtgatgacgcagtctccagccaccctgtctgtgtctccgaggggaancgccaccctctcctgcgtacgggccagtcgagtagttcgtagcgaggccgtacctttcgcccgttagggtacccaggaccaacggtaaacccgtgggacctacgggccctaccccgagggtcccttccctacacttacctagtcgacgttcgacctacgtacccgtaacgggaacgggcccaacggtagtaactaccgtacccgacgtaccgttaggttacagggtcgggacgtagggtcgggtcgtagggtacagggtacttaccgacctccaacgacctacgtacacgtaccgacgtccgtacggaccgtacgttacgtaaggtaacgtttacgtttacgtaacttttaaagttttaccgttacttacggttactacgttaacgtaagtttaaacgtaaacgtttaaccggttaccggttacccgttaaccgtttaaccgttaccgttttaccgggacccgggttacgggaacccgtaacgggttaacggtacggtaacggtaaccgtaaaccggtaaacggttccggttacggtaaccggttcggtaccggtaacccgttaccgttacg

SEQ ID NO: 69853 - DNA, 696 bp, Homo sapiens
  misc_feature: GYAE6OF02JYB8B.51.76.G10.1.454.CMB.1.raw
  modified_base (182)..(182): a, c, t, g, unknown or other
  misc_feature (182)..(182): n is a, c, g, or t
  modified_base (199)..(199): a, c, t, g, unknown or other
  misc_feature (199)..(199): n is a, c, g, or t
  modified_base (656)..(656): a, c, t, g, unknown or other
  misc_feature (656)..(656): n is a, c, g, or t
tcagcgatcgtatacacgaccggtgctcgatttagtcactcatacagggggaggaacgtgctcagttaggacccagacggaaccatggaagccccagcgcagcttctcttcctcctgctactctgctcccagataccactggagaagtagtgatgacgcagtcctccagccaccctgtcgtntgtctccgaaggggaanagcccaccctctaccgtgccagggaccagtacaggagtgttagctaaggccgtaacgttacgccttaggtaccacggacgtaacgaaaccgtcggaccgaaccggcctacccggaacgtcctacccgtacacttacccgtaagtcgaacgtcgaacctactacccggaaccgaaacgggtcccaacgtacaacgttactccccgaaagtacccgtaaggttacccgtaaggtacgggacgtacgggttcgggttacccggtaggggaacgttaggtaaccggttacctaccgttccgggtacctaacctacgtacacgtaccggtaacgtaccgtcgacgtacggtcgtacggtaagttacgtttactacgttatttatacttagtacctagtactatataacgtaacgtacgtacctacgttactacgtttacgaccggtagacgtagagaggtanacgtacgtaacgtacgtacgtagtaccgtagaccacgtcg

SEQ ID NO: 69854 - DNA, 829 bp, Homo sapiens
  misc_feature: GYAE6OF02GGH0U.51.76.G10.1.454.CMB.1.raw
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccacgtggagaagtagtgatgacgcagtcctccagccaccctgtctgtcgtctccgaggggaanacgcctaccctctcctgcagggccagtcaggngtgtagcagcgtactacgccgtggtaccagacaacgaaccgtcggaccgtacggtcctaccccgacggtccctccgtacacttctagtgtaacgtcgacctactacccgaaccgaacgggtacccaacgtttacgaaccgttacccgtacccgtaacggtacccggtaacggtttaccgaggggtttacgggaccggttaaggggtttccggggttaccggtaaccggggtaacgtttaacgggtaccggttttaccccgtaaccgtttcccgtaacccgtaaccgtacgttaccgaaacgcggtaacccgtcccgtaccgtaccgtacgttacgtaacggtaaacgttttcgtttaacgttaacgttttaaactttttaccggttaacgttaccggtaatacggttaacttaaggtttaactaaaccgttaaccggttacccggttaccgttacccgtttaaaccggtttaccggtttacccgggaaccggtaccggggtaacctaacggtccgggttaacggaaccggttaaccgtaaacccggtaaacggttacgttaggtccggtaaccgtacccggaccttacccgttacgg

SEQ ID NO: 69855 - DNA, 780 bp, Homo sapiens
  misc_feature: GYAE6OF02GQ7M9.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaanacgccaccctctcctgcgagggccagtcagagtgttagcagcgacttagcctaggtaccagcaagaacctggaccaggctaccccgaggtccttccctacgacttccgttaatcggatcgcctaacttaccccgaacgaaagggtcccctaagtcgtaacttacctaccccgaaggtaccctaggtttaccaaggttcgggacttaagggttcggggtaccgttagggggaacctaggttaccgtttacccgaaccgtttccgtaccaaacctacgttaccgaacggccctaaaccgggcccttacgggaccgttaaacggttccgttaaagggtaacgtttactttttacggaaccttttaaagtttttaccgttaaacgttggttaaccgtacggttaacctaaaggtttaaactttaaacgttaacccggttccggttaaccctttaccggttaacctttaccggttttaccgggacccggtaacgggtaaccctagggtacccggttaaggaaccgttaaccgtaaccgtaaaccggtacgtacggttacggacttacccggtaccgaacccgttacg

SEQ ID NO: 69856 - DNA, 746 bp, Homo sapiens
  misc_feature: GYAE6OF02GX69A.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccagccaccctgtctgtgtctccgaaggggaancgcccacccttctcctgcagggccaggtcagtagtgttagcacgacgtactagccgtagtaccagacaacgaacctggccaggctccccgagtcctcctacactctagtgatcgctacgtcccgaagacggaccacgtagaacctcgtaccccaaggtccctaaggttccgagtcgggtacgtacggggttgggtaccgtaggggtactaacggtacggttaccttccgtacccttacgtacccgtaaccgttaccgtaccggtacgtaccgaccgttaccggactacgttacggttaagttacggttaacgttttacttaacgtttaacgtttaactttaaccgtttacttaacggttaccgttaacggttaactttaaacggttaaacttaaccggtttaccggttaccgtttacccgttaccgttaacgtttaccgggttacccggtacgggtaaccggtaacggtaaccggttacgggtaacgtaaccgtaacggtaaccgttaaacggtcggttacggtaccggtacgtaccgtaccgttaaccc

SEQ ID NO: 69857 - DNA, 831 bp, Homo sapiens
  misc_feature: GYAE6OF02I1NA4.51.76.G10.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagatacccactggagaagtagtgatgacgcagtctccagccaccctgtctagtgtctaccgaggggaaanacgccctacccgtntcccgtgaccgacggggcctagtacccaggtaacggttggttaacgcgtaacggtccgtacctttaaggtcccgttagggttaacccgacgaccgtaacgtaaaacccgtggaccctacgggtccctaccccgaacgggccttccctacgaacttaccggttactagacgtcgtaccaccgtttaccgaaccggtaaccggggtaccctaaccggtaggtaaccttacccgttacccaccgggacctaacgggtttccaacggggtacggtcccgtaagggtttccgggggtacgtacgggtaacggtacgttaccggtttaccaaaccgttttccgacccgtaaccgtacgttaacccgacggtaaccgtacccggtaccgtacgtccgtaaggttaccgtaacggtaacgttacgtttacctaagttactttaaccgtttacgtacgtacgtagttaccgtaaacgttaacgttaacgttaccgttaccggtaccgtttacccgttacgttacggtttaccgggtacgacggggtacctaaaccgtggttaacgaagttaccgtaacgtaacggttaccttagggccgtttacggacgtaccgttaccctaaggg

SEQ ID NO: 69858 - DNA, 677 bp, Homo sapiens
  misc_feature: GYAE6OF02GNWVR.51.76.G10.1.454.CMB.1.raw
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgtacttagcctggtaccagcaagaaccgtggccaggcctccccgaggtcctcctcacttactagtgactgacactccaacgaacgggccacgtagactactcccgagaccgtagggttaccagggtcggacgtagggttcgggtacgtacggggactaggtacgttacacttccgtaccaccgtatccgagccagcctagactacgtacgtagtaagttagtttacgacttaaattttacgtacttacgtacctaaggtacgtaagtttaactaaacgttaccggtccgttaccgttaacccgttacgtttaccggtttaccgggacccggtaacgggtaccgtaacggtacggttaacgggtaacgggtaaccttaaaccgggtaaaccgttacggtttacgggtacggtacccgtaacgggttaccaccgtttaaccgg

SEQ ID NO: 69859 - DNA, 740 bp, Homo sapiens
  misc_feature: GYAE6OF02JWSVO.51.76.G10.1.454.CMB.1.raw
  modified_base (197)..(197): a, c, t, g, unknown or other
  misc_feature (197)..(197): n is a, c, g, or t
  modified_base (227)..(227): a, c, t, g, unknown or other
  misc_feature (227)..(227): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccagccaccctgtctgtcgtctacgaggggtaancgccaccctctcctgcgacgggcagtcagngtgttagcgagcgtacttacgccttaggtaccagcaacggaacccgtgggacccagggcctccccgaggtcccttcccactattcggtattagacgttgacctatcccgaagaaccgggtccaacggtagtaaccgttacctaccccggacggtacccttacgggttaccgtaacggggttcgggaccggtttaacggggtttccgggggttaccgggttacggggaaaccttaaacgggggtccgtttttaacccgaccggtttacctaccccgtaacccgtaacgttacggaccggtaccgtccggtacccggtacgtaacggttacgtacgtaacggttaacgttagttttacgtacttttaagtttaccgttacgtcgtactacgtacgtaagttactaacgtactccgtaccttacgtacttacggttcgacggtacggtactaggtcggtagtacgtaaccgacggtaaccgtacgtcggtaccgtactacggtacctaccgttacg

SEQ ID NO: 69860 - DNA, 815 bp, Homo sapiens
  misc_feature: GYAE6OF02JTN65.51.76.G10.1.454.CMB.1.raw
  modified_base (105)..(105): a, c, t, g, unknown or other
  misc_feature (105)..(105): n is a, c, g, or t
  modified_base (179)..(179): a, c, t, g, unknown or other
  misc_feature (179)..(179): n is a, c, g, or t
  modified_base (418)..(418): a, c, t, g, unknown or other
  misc_feature (418)..(418): n is a, c, g, or t
tcagcgatcgtatacacgaccggtgctcgatttagtcactcatacagggggaggaactgctcagttaggaccagacggaaccatggaagccccagcgcagcttcncttcctcctgctactctggctccagataccactggagaagtgtgactgacgcagtcctccagccctacctgtcngttctcctccgaggggaaactcgccctaccctcctccgtagccaacggggcccaggttaccaggtaggttcgttagccgaaggtccggaacttcgaccgttggtaccccaaggaccgtaacggaaaacccgttcgggaccacgggtcctaccccgtaggccctccgtactactacgtacttggaactcggtccaagtacccgacggtaaccggcctaacgtacgtacctagtacccccnggtaccgtaacggttccaacggggtcggaccggtaggttcggggttcgtaacggggattacggtacgttaccgtaacccttcgtacccgtaaccgtaacgttccgaacggaccgtacgggtaccctcggtacgtaccggtaccgttacggtaacgtttaccgtttacggttaaccttaacgttttaacgtttccgtttaacgtacgttacggttaacttaagtttaactaaacgttacggttaccgtaaccgttaccgttaccgtttaacggtttacggacccggtaacgggttacccgtaaggtaaccggttacgggtaacggttaacctttaacccggaaaaccggtttacgttaacgggtaccggttacgaccgggtttaccaaccctttacgg

SEQ ID NO: 69861 - DNA, 657 bp, Homo sapiens
  misc_feature: GYAE6OF02I6YLL.51.76.G10.1.454.CMB.1.raw
  modified_base (196)..(196): a, c, t, g, unknown or other
  misc_feature (196)..(196): n is a, c, g, or t
  modified_base (630)..(630): a, c, t, g, unknown or other
  misc_feature (630)..(630): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtgtctccgaaggggaancgccaccctctcctgcgacgggccaggtcagagtgttagcagcacttagcctggtaccagcaagaacctggccaggcctcccgaggtcctcctacactctagtcgactgccgactcccgaacggaccggcctaactgaacttaccaccctaggacccgtaggttaccgaggtcgggctagggttcggggtctacggggaactagtacgttaccaaccttcgtaccaaccggtaatccgaacgtcaacgtccgtacgtactacggtacgtaacgttaagttattttcgtaaacgtttaatttttacgtaccgttagtcggaaattacggtaactttaagttaaacgtaccgttaccgtaccgttacccgttaacgtttacgtttaccgaccggtacgggtaccaacggtcgtaagggaactacgtaactaacggngttcggtacgctaccggactacttacg

SEQ ID NO: 69862 - DNA, 805 bp, Homo sapiens
  misc_feature: GYAE6OF02IWFDD.51.76.G10.1.454.CMB.1.raw
  modified_base (537)..(537): a, c, t, g, unknown or other
  misc_feature (537)..(537): n is a, c, g, or t
tcagcgatcgtatacacgaccggtgctcgatttagtcactcatacagggggaggaactgctcagttaggacccagacggaaccatggaagccccagcgcagcttctcttcctcctgctactcgtggcctcccagataccactggaagaagtagtgatgacgcagtctccagccacacgtgtctgtcgtctacgggaagggaatccgcccctacctccgtacgtggaccggacggccgtactagaacggtgttagtacgacctacggacttaacgtcgtcccgtaacgtaccgaaggacgtaaaccgtaacccggtcgggaaccgacgggtccccgtaaaccggtccggtcccttacgtaaccctaggtttacctaaggttacgacgtcgtaacgaacctaaccccgggaaggacccggtcctaagtaggtacctacccacgaccgtgtacggttacgacggtcgtacgagggttcggaagtgggaacctaggtacgttaacacccgttactcccgtaactacgtaccgacggtaacncccggtaacttcggactacggttacggaaacgttaggttttaacgtttaacggtaattttaaacgtttacgttaaccgttaggacctaagttaacggtaaacgtttaaaacgtaaccggtacgttaccgttaccggtttaaacccgttaaacgtttacgggttacccggtacgggtaacgggtaacccgtaagggtacgggtaagtaaaccgtacgttaaaaccggaaccgttaggttaccggtacgtaacggttaccaccgtaaacc

SEQ ID NO: 69863 - DNA, 759 bp, Homo sapiens
  misc_feature: GYAE6OF02IQ52N.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgattttagtcactcatacagggggaggaactgctcagttaggacccagacggaaccatggaagccccagcgcagcttctcttccctcctgctactctggcctcccagataccactggagaagtagtgatgaccgcagtctccagccaccctgtctgtgtctcgaggggaanagccaccctctcctgcaggccagtcagagtgtagcacgcgtacttagcctaggtaccagcaacgaaaccgtggacccaggtccctcccgaggtcctaccctcgtaacttacgttagtgaagtcgactaacttacccgaaccgaagggcccctacgtagtaacgttaccctaccccgaggtacccgttacgggtttacaacgggtttcggaccgttaagggttcgggtaccggttggggaaaccctaggtacgttttccaaccctttcgaccctaacctagtccgaacgcgaaccggtaccgttcggaccgtacgttacgttaagtaacggttttaagtttttacggtaaacttttaacgttttttaacgtttaccgtttagtaaccgtagttaaccgtaaggtttaaattaaacgttaaccggttacggttacccctttaacggttaacccgtttacggttttaccgggacccgtacgggggaaccttaaccgggtcgttaacgggattaaacaccggtaaactaaccggtcgtaccggtactacgtacctaccgttacg

SEQ ID NO: 69864 - DNA, 693 bp, Homo sapiens
  misc_feature: GYAE6OF02JNLLD.51.76.G10.1.454.CMB.1.raw
tcagcgatcgtatacacgaccggtgctcgatttagtcactcatacagggggaggaactgctcagttaggacccagacggaaccatggaacgccccagcgcagcttctcttcctcctgctactctggctcccagactaccacgtggagaagtagtgatgacgcagtcctccgagcccacctgtctgtacgtccgtaccgaaggggaaactcgcccctaccctcgtcctgccgaggtccagtcgaagtgtgtacgcgtcggaccgtacgttcgcccgtaggtaaccagaccgaacgaaaccgtcggaccacggtcctacccgagtcctcctctatactatagatcgactaccgtacaacgaacggtccacgttacgaactccgtacccgaaggtccgtacgttcgaacgttcggaccgttagggtggtaaccgtagggaatacgtacgttcaccttacacgactactacacgtcctaacggtcctaggtactaggtctaacgttacggttatttacgtaactttaagttttccgtacgtacgtacgtaacgtaccgtttaagtaacgttaacgtaaccggttcgttacccgttaacgttaccggttacgttaccggacggtaacggacgtacgtacggtaacgtacggtaattaccggaaacgtttcgacggtctacgtaccctcgtaacctcgg

SEQ ID NO: 69865 - DNA, 693 bp, Homo sapiens
  misc_feature: GYAE6OF02H09HQ.51.76.G10.1.454.CMB.1.raw
  modified_base (204)..(204): a, c, t, g, unknown or other
  misc_feature (204)..(204): n is a, c, g, or t
  modified_base (482)..(482): a, c, t, g, unknown or other
  misc_feature (482)..(482): n is a, c, g, or t
  modified_base (543)..(543): a, c, t, g, unknown or other
  misc_feature (543)..(543): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagatacactggagaagtagtgatgacgcagtcctccagccctaccttgtctcgtgttccaccggaaggggaaacncgccctaccttcctcgtgcgacggccgagtcagtagtcgttagcagcgtagttacgcgttacggacagacgaacgtaacgtcggaccgaggtcctaccgacggtcctacctactacttacttagtagttagccgacctaaccgaccgaaccggtaaccgggctacgtacgtaactacccgaccgtaacaccggttaggttacggcggtaacggtcgttagggtacgggtacgacgggtacgtagttacgtcccgtatacccgacctctacgtacgacncggtctccgtgacttacggtagtacggttaattttacgttagttaacttaagttttacgtnttaggtcctaacggtagttaaactaactttaacgtaaccgttcgtacccgtttaccgtacgttacggtttaccgacggtacgtacggtacgtcggtacgtaacgtacgtaagtaaccggtaggtcgttacggagttacccgctacttcgg

SEQ ID NO: 69866 - DNA, 822 bp, Homo sapiens
  misc_feature: GYAE6OF02JJY0I.51.76.G10.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactgggagaagtagtgatgacgcagtctccagccaccctgtctgtcgtctcgaaggggaaancgcccacccttctcctgcgacgggcctagtcgagngttgttagcagcgtacttagccgttggtaccagaccaaggtaaaccgtggcctagggcccttaccccgaagggtcccttccgtacacttacgtaatcggtactcgctaacgtaccccgaaaccgggtaacgggtccaacttacggtaaccgttaaccgtccccggaaccggtaccggtaacgggttttaccggaaccggggtttggaccggttaaggggtttcggggttacgttaacgggggaactaacgggtttacgttacccgttaacccgtttctaacccgtaaccgtaaccggtcgaacgggtaccccgacggttaccccgtttagggaaccgttaccgggtttaccggttaaacgggtttaaactttaaccggtttttaaccgtaaactttaacgtttttaacgttaccgtttagttaccggtaacgtacggttaaattaaacgtttaacggtaccgttcgggtaccctttaaacggttaccgtttaccgttacgggtaccgtaacggttaacgtcgtaacgggtacgtagtaaccgtaacgaaccgtttagttcgggtacgttacgcgtactacccgttgg

SEQ ID NO: 69867 - DNA, 721 bp, Homo sapiens
  misc_feature: GYAE6OF02GJBZ2.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcaggtagtgttagcaggccgtacttacgccgttacggtaccaacgaccgtaaacggaaacccgttcgggaccgacgggcccttaccccgaggtcccttccctctaacgtttctagtcgtacgtcgtacctactaccgaaccggtaacggggcctacgtacgtaacaccgttacccgacggtccgtagggttacaggggtcggtacgtagggttcggtagtagaaggaactacggtacgtttccaccttccgtacacctataccgacgtacgaccgccttggaccgtaggttcgtaacggttaaacgtttacgttttacgtaacttttaaacgttttacgtacgtttcgtaccgtagtaacttacgtttaaataacgttaaccggttccgtaacccgttccgttaacgtttacgttccggacgggtacgtaaccgggtacgtaggtacggaacgtacgtaaccgtaacggtacgtacggtacgcggtaccgacgtaccg

SEQ ID NO: 69868 - DNA, 878 bp, Homo sapiens
  misc_feature: GYAE6OF02HC7OK.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggctcccagataccactggagaagtagtgatgacgcagtctccagccaccctgtctgtgtctcgaggggaanacgccacctctcctgcgagggccagtaccgagacggttgttagcgtacgtacggtaccttaggtcccgttacgggtaacccacggccgtaaacggtaaacccgtcgggaacccacgggccccttaccccgacgggtccctaccccgtactaccttaccgttaagttacgtaacgttccggaacctaccgttaccccgtaaaccggaaccggggttacccctaacgtacggttaacctaaccgtccccgtaacggtacccgttacggttcgacggttcggaccggttagggttcgggttaccgtacgggggaacccttaagggtaccgtttacccaccgttacccgtaaccgtacccgtaacgtccgaacgtaccgtaccggacccgttaggaccgtacgttacttaacggtaagtttacgttttaccgtaacgtttaacttttaacttaacccgtaggttaacccgtaagtaccgtaaagtttaaccgtaaaccgttaacggttaccgttacccccgttaaccgtttaaaccgggtttaccgttttaacccgggggtaacccggtacccggggttaacgtaaccggttaccgggtaaaccggtcggttaaacgtaaacccccggtaaggtttaaccgttacggggtacccggtaccggtttccgaccccgttaccggttacc

SEQ ID NO: 69869 - DNA, 820 bp, Homo sapiens
  misc_feature: GYAE6OF02ILB9T.51.76.G10.1.454.CMB.1.raw
  modified_base (120)..(120): a, c, t, g, unknown or other
  misc_feature (120)..(120): n is a, c, g, or t
  modified_base (656)..(656): a, c, t, g, unknown or other
  misc_feature (656)..(656): n is a, c, g, or t
tcagcgatcgtatacacgaccggtgctcgattttagtcactcatacgagggggaggactgctcagttaggaccagacggaaccatggaagccccagcgcagcttctctcctctgctactntggctccagataccagtcggagaagtaggtgaattggaccgcgtagtcctaccgaagcccgtacccgttggttctaggttcggtctaccggaagggggaaactcgccctaaccctcttccgaggctaacggggcctaagttccgagtaacgttcggttaacgcgaagtccgaagtttcggaccccgttaggtaccctaaggtaaccgtaacggtaaaaaccgttcgggaacccgtacggggtacccttaccggaacgggtccttaccccggttacaactttacccggttaagtaccggttaaacgtacggtaccgtaacctacccgtaacggaaccgggtacccgtaaacgtttcgaacgtaacgtaccgtaacggcccgttaaggtccgtaagcggtacgtacgggtaggtaccgttacggaggtaactacggttaccacgttactacgtacacgttacgaaacgcttaacgccgtagtacgacgttcgaagttaagttagttacgtaacctttaaggtttacctagtacctagnggtaacctaaaggtttaacaacgttaacggtactccggttaaccgtaaacgttaccggttacggaaaccgtacggggaaactacggggttacgtaaggtaacccgtaagtttacccgaaacggtttcggaccgttaacggactaacgtccgtaacggtttaacc

SEQ ID NO: 69870 - DNA, 666 bp, Homo sapiens
  misc_feature: GYAE6OF02G2NQB.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgccacctctcctgcgaggccagtcagagtgtagcagcgacttagcctggtaccagcaacgaaacctggaccaggcctacccgaggcctccctactacgttctatgagtgaccactaccaacgacgggcctaacgtgtactactacccgacgccgtaggttcgtaggtcggcgtaggttcgggtcgtacggggaactaggtacgttccactccgtaccaccgtatccgagtccgacgcctgacgtacgtcgtaggtaagttactttcgtacttaagttttacgttacttacgtacgacgtacttaaacgttaacttaaacgttacgttacgttacccgtttacccggttaaactttaccggtttacgggacccgggtaacggggtacccgtaaggtccggtaaggaacgttaacgtaaccgtaaacggttaccgttacgggtacgtcgtaccggtacctaccggttaacg

SEQ ID NO: 69871 - DNA, 544 bp, Homo sapiens
  misc_feature: GYAE6OF02F8GIN.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgactactcccgagccaggttcaggtcggcaggtgggtctggggacagacgttcactctacacatcagcacgcctgcagtctagaagtattttgactaatttattactgtcagtactagtataataacgtcgtacctaccgtacttacgttttcggaccgtacgggacctaacggtcgtagggacgtaacgttacgaaacggtacgtacggtacggcgtacgtaccaccgtacg

SEQ ID NO: 69872 - DNA, 661 bp, Homo sapiens
  misc_feature: GYAE6OF02GDBG2.51.76.G10.1.454.CMB.1.raw
  modified_base (298)..(298): a, c, t, g, unknown or other
  misc_feature (298)..(298): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagcgccaccctctcctgcagggccagtcagagtgttagcagcgacttagcctggtaccagcacgaaacctggccaggcctcccgaggcctcctcatctatgangacacgtaccacgaacgggccactcgatactcccacgccgtaggttccaggtcggacgtaggtgggtacgtacgggactacggacgtttccaacgttcctaccgtacctacgtacgacgacgacgtcccgtagacctacgtaccgtagtaacgtttattttacgacttaaagttttacttacgttagtaccgttaagtacttaacgtaattaaaccgttaaccgttaccggttacccttaccggttaaccttaccgtttaccgggaccggttacggggaacctaacggtcggtaacggtaacgaaccgttaaccgtaaaccggtacggttacggtacgggtactcgggtacctaccgttaacg

SEQ ID NO: 69873 - DNA, 795 bp, Homo sapiens
  misc_feature: GYAE6OF02ITF7P.51.76.G10.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagcgatcgtatacacgaccggtgctcgatttagtcactcatacagggggagaactgctcagttaggacccagacggaaccatggaagcccccagcgcagcttctcttcctcctgctactctggcctcccagactaccactggagaagtagtgatgacgcagtcctaccagcccaccctgtctgtcgtctccgaggggaacncgcccaccctntcctgcacggcctagtcagagttgtacgcacgcgtacttacgccgtaggtaccagaccaagaacccgtggacccgaggtccctacccgaggtcctacccgtactacgttacctaggtacgtaacgtccgaccgtaactaccccgtaaacgggaaccgggtcccaacgtacgtaaccttaaccgtcccccgaacggtaccccgttaaggtttccagggttacggacgtagggtttaccgggtacgtacggggtaaacctaaggttaccgttaccaccgtacctaaccgaaccctagtacccggacgtacgacggtccgtaacgtccgtaaggttaccgtaaggtaaaccgttttacgttttaacggaaaccttttaacgttttaactccgttaccgtaaacgtcgtaaaccgttaaagttaaccgttaaaccgtaccgggttcccttaacccgtttaccgttaaacgtttacggttccggggaaccgtacgggtaaccctaacgggccgtttaacggactaaccggtaaacccgtaaacgttacggttcggtaaccggtcccgtacgacccgttaaccgttg

SEQ ID NO: 69874 - DNA, 661 bp, Homo sapiens
  misc_feature: GYAE6OF02IVND2.51.76.G10.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (645)..(645): a, c, t, g, unknown or other
  misc_feature (645)..(645): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggaagagtagtgatgacgcagtctccgagccaccctgtctgtgtctccgaggggaaancgcccaccctctcctgcagggccagtcgagagtgtagcagcgacttgccgtggtaccagctagaacctgccagcctcccagcnctcatctagtgatcgctactacccgaacggtaacggcctaacgtagtacttacctcccgaagtcccgtaaggttcacgggtttgggactagggtcgggttacgtgggaactaaggacgttccgacttacctacccgaactacgtaccacgacgaccggtcctacggactacgttacgtagtaacgttagttttcgaactttaacgttttcttaacttgtaccgtaagtaccgtaacgttaagtttaaaccgtaacgttacccggttccttaaccggtttactttacggtttaccgacccgggtacggaacccgtaagggtccgtaaggaacgtaactaacgtaaaccggttatcggttaacggcncggtaccctgtaaccg

SEQ ID NO: 69875 - DNA, 607 bp, Homo sapiens
  misc_feature: GYAE6OF02JYUBB.51.76.G10.1.454.CMB.1.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (598)..(598): a, c, t, g, unknown or other
  misc_feature (598)..(598): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccacgtggaagaagtagtgatgacgcagtctccacgccaccctgtctcgtgtcctccgaaggggaaanacgccctacctctcctgcgagggccagtcagagtgtagcagcgtacttacgccgttaggtaccngacgaacgtaaaccgtggaccgacggccctaccccgaggtccctcctcgtactctatcgatcgaccactacgaacgtaacgggccagttgactacctccgactccggaaggttcaggtcggacgtagggtccgggttgaggggtacagttcgttaccgacttcctacaccgtactcacgcacgtccgatccgtagtctaaggtagttactttgaccttaagtttacttcgcgtacagtagttaataacgttaacgtacgttaccgcctttacgtcgttacgttcggacggacgttcaagtcgtaggactacgaacgatacgtgccgttacngtcctagtc

SEQ ID NO: 69876 - DNA, 861 bp, Homo sapiens
  misc_feature: GYAE6OF02HQQMR.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactaggagaagtagtgatgacgcagtctccagccacctgtctgtgtctccgagggaancgccacctctcctacgacggccagtcagtgtgtagcgagcgtacttagccttacggtaccagtacgaacgaaaccgtcggccgaggccgtcccgaggtcctccgtcactctatgtatcggactactccgtaacgaacgggtccacgtcggtaactaccgtaccccgaacgtacccgtacgggttaccgacggtcggggtaccgtacggggttcggggtttaccggttacgggggaaccgtaaggtttaccgggtttaaccctaaccggttttaccccgtaccgtaaccccttaacgttacccgtaaccggtacccgtaaccggtacccggttacggacccgttaaacggttaccgttaacggttaaacggttttacgttttacggtaaaccgtttttaacgttttaaacgttttaaccgttaacggttaccgtaaacggtacgttaaaccgttaaaacgtttaaaccgttaacccggttaccggttaccccgtttaacccggtttaaacccggtttaccgtttaaccggggaacccggtaaccggggtaccgtaacgggtacggttaacggggtaaaccgttaaccggttaaaaccgtaaaccggtaacggtttacgggtaaccggttaaccggtacgtaacccgtaccgttacctttaacccgg

SEQ ID NO: 69877 - DNA, 745 bp, Homo sapiens
  misc_feature: GYAE6OF02GO3WX.51.76.G10.1.454.CMB.1.raw
  modified_base (197)..(197): a, c, t, g, unknown or other
  misc_feature (197)..(197): n is a, c, g, or t
  modified_base (282)..(282): a, c, t, g, unknown or other
  misc_feature (282)..(282): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccacctctccgtgcagggtccagtcagagtgtagcagcgacttagctagtaccagacagaaactggacaggctccgaggctcncgatctatcgatcgcactaccaacgaacgggccacgtacgtactacgtcccacgaccgtaaggttacaacggtcggactagggttcgggtacgttcggggaacagggtaacggttaccaaccgttccgtaaccgtaaccgtaactaccgtaaggccctaaggtaccccttaggaccgaacggttccttaaggaaacggtttaaacggtttttacgaactttaaaacggttttttacttaaaacgttcggtttaaccaaggttaacctaaaagttaaccgtttaaaaacgttaaacccggttaccgggttaccccttaacccggttttaaacgtaacccggtttttaacgggaccccgggttaacgggggtaaacctaagggtacccgttaggggtaacgtaacgttaaaccggaaaacggtaaacgttcgggttaaaccgggttcagggtaccctaacctacg

SEQ ID NO: 69878 - DNA, 626 bp, Homo sapiens
  misc_feature: GYAE6OF02IK1J2.51.76.G10.1.454.CMB.1.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (330)..(330): a, c, t, g, unknown or other
  misc_feature (330)..(330): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtcgtcctccgaggggaaancgcccaccctcgtcctgcgagggccagtcaagtgtgtagcagcgattacgctggtacagcagaactgccaggcctccaggctccnctactctatcgatgctgacccaagaggaccctagtagacttaccnccgacgtcgtacgtcgagtcgacgtggtacggtcgacggacgtacgtagttccgtacctctaccgaaccgagtacgagacctacgctagacgtacgtactaggtaattacgttactacttaactttacgttacgtgtacgataacgttaagttaactaaacgtaccgtccgggttaccttacccgttaactttaccggttacggaacccggtaaccggtaacgtacggtcggttaacggaactaaccgaaaccgttaacggtacgtcggttaccgtcgtaccttaccgtacctagg

SEQ ID NO: 69879 - DNA, 605 bp, Homo sapiens
  misc_feature: GYAE6OF02H3C22.51.76.G10.1.454.CMB.1.raw
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
  modified_base (339)..(339): a, c, t, g, unknown or other
  misc_feature (339)..(339): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagacgccaccctctcctgcgagggccagtcagagtgttagcagcgacttacgctggtaccagcaacgaaccgnggaccaggcctcccgaggtcctcctacatctangatgcactaccgagaacggccacgtagatactcccganccgtagttcaggtcgcgtagtgggtcgtagggacaggtagttccactccgtaccgaaccataccgacgccacggcctgcgtagttcaggtaagttagtttacgtacttaatttacttacgtcgtacgtagtactagtaactaactaacgtcgtacccgttaccgtacgttacgtttacggaccgtacgggacctacggtcggttaaggacgtaactaaccgtaaacggtacgttacggtcggtaccgttacggacctaaccgtacg

SEQ ID NO: 69880 - DNA, 799 bp, Homo sapiens
  misc_feature: GYAE6OF02GQPD2.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccacctgtctgtcgtctccgaaggggaaancgcccaccctctcctgcgacgggcctagtacagacgttgttagcagcgtacttacgcctaggtaccagacaacgaaaccgtcggaccacgggtcctcccgacggtcctacctacacttctagtgtacgtcgacctaacgtcccgaaacggaacgggcctaacgttagaaccttaccaccccggagtacccgtacggtttacgagggttcgggccgttaggggtcgggttaccggtacggggaaactacggggttaccgttttacaaccccgtttacgtacccgaaacccgtacgtacccgtaaccggaccgtaaccggtcccggttaccggaaccgttacggttaaccgtaacgggttaaacgttttaacgttttacggtaacctttttaaaggttttacccgttaacgttccgtttaaaccgagtttaaccgtaaacggtttaacctaaacggtttaacggttcccgttacccgtttaaccgttaccgtttaacgggttcccggaaccggtacgggtacctaacgggtcgtaacggtaacgtaaccgtaaccggtaaaacttccgggttgtaccgggacctttacggaccttacgttac

SEQ ID NO: 69881 - DNA, 736 bp, Homo sapiens
  misc_feature: GYAE6OF02FNCQK.51.76.G10.1.454.CMB.1.raw
  modified_base (183)..(183): a, c, t, g, unknown or other
  misc_feature (183)..(183): n is a, c, g, or t
  modified_base (198)..(198): a, c, t, g, unknown or other
  misc_feature (198)..(198): n is a, c, g, or t
  modified_base (305)..(305): a, c, t, g, unknown or other
  misc_feature (305)..(305): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacccgtgtctgtntctcgaaggggaaancgccaccctctcctgcgagggccagtcagacgtgtagcagcgtaacttagccctggtaccagtccgagaaacctggccaaggcctacccaggcctcctactactctntagatcgaccacgtaccaacgaacggggacctaacgtagacttaccgtacccacgtaccgtaacggttcagggttcggcgtaagggttcgggtacgtaggggtaacaggtaacgttcaaccgttcctaacccgaacctacgacctacggtaccaacgggtaccctgggacctaggttaccgttaacggtaaggttaactttttcggaactttaaacgttttaagtttaaccgtagttacacggtacctaagttaacgtaaactttaacggtaccgtacccggttacccgttaaccgtttaaccgggttttacggacccggtacgggggtaaccctaacggtaccggtaacgggtaaacggtaaccgtaacccgtaaaaccggttaacggttacggtaccgggtacgttaccggtacctaaccttaacccgg

SEQ ID NO: 69882 - DNA, 827 bp, Homo sapiens
  misc_feature: GYAE6OF02H1MCZ.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatcgacgcagtctccagccaccctgtctgtgtctaccgaggggaaacgcgcccaacccttccgtcctcggacgtacgggaccacggttccagaggttgttaacgcgaacgtccggacgttacgtcccgtgggttaacccacggtacaaacggaaaccccgtcggaccacggtccgtacccgagggtcccttcccctacaacttcgttaactcggtacgactacttacccaacccggacgggtacccaacgttcgggacaccgtaccccgaggtaccccgtaaggttaccgaagggttcgggtaaccgaaccggggtcggggttaacgttaccggggtaaaccgacggttaaccgtttcggaccccgttccggtttaccaacccgtacgaaccctaacgggcgaaccggttaccccgtaacggtaaccggtcccgtaagtaaacgttaccgttttacggtacccgttaaggtttttaacctttaaggtttaccgttacgacgtaaccgtacggaaccgttaaaaccgtaaccgttcggtaaccttcggttaccggtacgttacccggaccggaacggttaccgaaggttaacggaaacctaacggaaaacccgttacgtaacggttggaacccgtacgaaccgtaccctaagttacccgttacgttccgttaaccg

SEQ ID NO: 69883 - DNA, 724 bp, Homo sapiens
  misc_feature: GYAE6OF02HYWKH.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaacgccacctctcctgcagggccagtcagtagtgttagcagcgtattacgcctaggtaccagcgaagaaccgtggaccaggcctcccgaggtcctaccgtactacttacttatacgatcgcactaccgacgaagggccctaagtagactacctaccgacgccgttaggtacgtaggtacgggacgtagggtggtacggtacggacgtagttacgttaccacgtacctaccgtaccgtactacgacgaccgtaacgtccgtagctaacggttcgtaaggtaacgtttatttacggtactttaaacgttttaacgtttacgtacgttacaacgtacgtaaagttaacgttaaaccgtaaccggttaccgttacccgttaaccgttacgtttaaccggtttaccgggaccggtttaaccggggtaacctaacgggtaccggttaagggtaaccgtaacgttaaaacccggtaagggttaacgttaccgggttacggtaaccggttaccgggtacccttaaccgtttaaccgg

SEQ ID NO: 69884 - DNA, 724 bp, Homo sapiens
  misc_feature: GYAE6OF02I0FSV.51.76.G10.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagcgatcgtatacacgaccggtgctcgatttagtcactcatacagggggaggaactgctcagttaggacccagacggaaccatggaagcaccagcgcagcttctcttcctcctgctactctggctcccagataccactggagaagtagtgatgacgcagtctccagcccacctgtctgtgtctccgaaggggaancgcccaccctctcctgccgaggccagtcagagtgttagcagcgtacttagcctaggtaccagacaagaacctcgaccacggcctccgagtcctcctctactctatgtanacgcacgtccacgaacggccacgtgatctcccgagtccgtaggtcagtggacgtggtacggtacgtacgggactaacggtcgttacctaacgttcctaaccgaaccgtacgtaccgacgtaccgtaccgtaccgtaggtaccgtaacggttaccgtaaaggtaaccgtttagttttaccgtaacgtttaaacttttaacgttaaccgttcgttaacgtaaaccggttacgttaaacggtttaaacttaaaccggttaacgttcccggtttaaaccccgttaacggtttaacccgttaaccggttttccgggaacccggttaacggggtaaccccgtaaaggttccgtaacgggtaaactaacgttaaccggtaaaccgttacgttacgggtaccggtaacctacggaccccttaacgg

SEQ ID NO: 69885 - DNA, 715 bp, Homo sapiens
  misc_feature: GYAE6OF02GWPI2.51.76.G10.1.454.CMB.1.raw
  modified_base (661)..(661): a, c, t, g, unknown or other
  misc_feature (661)..(661): n is a, c, g, or t
tcagcgatcgtatacacgaccggtgctcgatttagtcactcatacagggggaggaactgctcagttaggacccagacggaaccatggaagccccagcgcagcttctcttcctcctgctactctgctcccagataccactggagaagtagtgatgacgcagtctccagccacctgtctgtgtctccgaggggaagacgcccacctctcctgcgacgggccagtcagtagtgttagacgagacgtacttagccgttaggtaccaggtaccgaaggaaacccgtggaccaaggtcctaccccgaggtcctccgtacactctatgatcgcactaccagacggcctacgtgactaccacccagtccgtaggttcgaacggttggacggtaggttcggggtacgtacggggacgtaacggtacgtttaccgtaccttacctacccggtaaccctaccgtaacgtacggaacccgtaccggtacccgtaggtaccgtaacgttacgttagggttaaaccttttagttttacggtaacttttaaaccttttgttaaccgttacgtagtaaccgttagtaacggtttaaacttaagttaaaccttacgggtcccttaaccggttactttacgttacccgggaacgtacgggtaacctacgggtcggtaanacggttaacgaacgtaaccggtacgtcgggtacgtcgtacgtacgtaccgtacg

SEQ ID NO: 69886 - DNA, 604 bp, Homo sapiens
  misc_feature: GYAE6OF02FMSYQ.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcgagggccagtcagagtgttagcagcgacttagcctggtaccagcagaacctggccaggcctcccgaggcctccctcattctatgatgcactaccacgaacggccagtgactactccgacgccgtaggttcaggtcggacgtaggtgggtactgggactagtacgttcacgttcacacctacgtcgacgcgacgccgtcgactacgttacgtagtaagttagtttagactttaagtttagttacttcgtactagtacgtaagttaataacgttaacgtccggtaccgttaccgttaccgttacgtttacggaccggtacgggaccgtaacggtcggtaggaagtacgtaacgtaaccggtacgtacggtacgtcgtacgtaccgacgtaccg

SEQ ID NO: 69887 - DNA, 694 bp, Homo sapiens
  misc_feature: GYAE6OF02IVOS0.51.76.G10.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaancgccaccctntccngcagggccagtcagagtgtagcagcgacttagccgtaggtaccagcaacggaaacctggaccagggcctaccgaggcctcctcaactctactgactgactactaccgacgaacgggcctagtcgtactactacccgaggccgtaggttaccaggtcggcgtaagggttcggggtacgtagggggaactagggtacgtttcccaacgttcccgtacgaaccctactaccggaacgtccacggtccctggacctacggttaccgtaaggtaactttacgttttcggaacttttaaagttttacttacgttagtaccgaagtacttaaacgttaacttaaagtaccggttcgggtaaccctttaccggtaacgtttaaccggtttcgggaacccgggtaggggtaaccctacgggtcggttaggtaaagtaaccgttaacgaaaccggttacgttcgggaccggtctacggacctacccgttaacgg

SEQ ID NO: 69888 - DNA, 594 bp, Homo sapiens
  misc_feature: GYAE6OF02FTWMM.51.76.G10.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (399)..(399): a, c, t, g, unknown or other
  misc_feature (399)..(399): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtgtctccgaggggaaancgccaccctctcctgcagggccagtcagagttntagcagcgacgttacgcctggtaccagccagaaaccctggccaggcctccccaggcctccgtacattcctattggatgccatccaacacgggccactgactatcccgagcctaggtttccaggtcggtcacgggtgggtctggggactagagttcacttctcaccgtntcgacgacacgcctgctagtctagaagttatttacgactaacgttttacttactacgttcgtacgtctaagttattaacgtaacgttacgtacccgttccgtaaccttaccggtttacgaccgttacggggaccctaacggtcgtaaggacgtaagtaccgaacgtaacgtgtaacgcgtacggacctaccctag

SEQ ID NO: 69889 - DNA, 625 bp, Homo sapiens
  misc_feature: GYAE6OF02IHT17.51.76.G10.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (281)..(281): a, c, t, g, unknown or other
  misc_feature (281)..(281): n is a, c, g, or t
tcagcgatcgtatacacgaccggtgctcgatttagtcactcatacagggggaggaactgctcagttaggacccagacggaaccagtggaagccccgaagcgcagcttctcttcctcctgctactctggcctcccagataccactggagaagtagtgatgacgcagtctcagccacctgtctgtgtctccgaggggaaancgccacctctcctgcgagggccagtcagagtgtancagcgattagcctggtaccagcaagaacctggaccaggcctacccgnggacctccgtcatctatgatgacatccagaacgggccactgactacgtcccagccaggttcagtcggaccgtaggtcgggtcgtagggactaggtacgtttccaccgttcctacctaacctacgttccgaacgtccgacgtacccgtgaccgtaacgtcgtaaggtaacgttaacgttttcgtaacttaacgttttacttaccgttacgtacgtacgtacgtaaggttaactaagttacgtcggtcccttaccgtacttacgtttacggaccgtacgggtaacctacggtcgtacggatacgtaaccgaaacgtcgtacggtagtaccgacgtacctacgtacg

SEQ ID NO: 69890 - DNA, 988 bp, Homo sapiens
  misc_feature: GYAE6OF02IVCXC.51.76.G10.1.454.CMB.1.raw
  modified_base (145)..(145): a, c, t, g, unknown or other
  misc_feature (145)..(145): n is a, c, g, or t
  modified_base (184)..(184): a, c, t, g, unknown or other
  misc_feature (184)..(184): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagataccactgganaagttagtgatgacgcagtctccagccaccctgtctgtntctcgagggaatcgccaccctctcctgacgtagggccctagtcagtagtgttacgcacgcgaccttagccctggtaccagcgaagaacctggaccaggcctacccgaggtccctccgtactactacttaagtcgtaagtcgtaccgtaacgttacccgaaccgggaaccgggtccctaacgtttacggtaaaccttacccggttacccccgtaacggtaccccggtaacgggtttttaccgaacggggttttacgggacccgttaaaggggggttttccgggggtaaccgtttaccggggggtaaacccgttaagggtttaacccgggtttaaccctaaccccgggttttccctttaaccccggaaaccctttacccgtttaccggaaacccggttaccgttaaccccgggaaccccggtttggtaaacccgttaaacgggtttacccggttaaacggtttaaaacggtttaccgttttttaacgggtacccttttaaaacggtttttttaaaccttttaaccggttaccggtaccggttaaacgttaacccggtttaaacgttttaaacccgtttaaaacggtttacccgggtaaccggttttaacccccgtttaaccgggtttaaacccggtttttaaccggttttacccggggtaacccgggtttaaaccgggggacccgtttaaaacggggtccccggttaagggtttaaccggtaaacccgtttacccggttaaaaaccggttacggttacggtttaacccggggaccctttaaccggtaccgttaaccccgttaacgg

SEQ ID NO: 69891 - DNA, 750 bp, Homo sapiens
  misc_feature: GYAE6OF02H8OIM.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagttgtgatgacgcagtctcagcccaccctgtctgtcgtctccgaagggggaacncgcccaccgtctccgtgcgacgggccagttcgaaggtcgttgttacgcgagtccgtacgtttacggccgttacggtaccaagtcaacggtaaccgtggaccaggtcctaccgaggtcctcgtcatctagtgacttgactactccaacggacggtccaacgtcgtaactaccgtacccgagtaccggtacgtcgtacgggtcgtacggtacggtcggtacgacggtctaagtagttccaccgtgtaccgtaacacttcgaacgtcgtaacgtcccgtaggtaccgtacggtacttaagggtaacgtttacgtttaagtacccgttttaaagtttccgtttaacgtacgttaaccgtaacgtttaccgttaaacgttaacgttaaacgttacccggttaccggttaaccgttaacccggtttacgtttaacccgtttacggggaaccccgaaggggttaacccgtacggttacggtaacgggttacaacccggttaaaccgaaccggtttacggtaccggtaccgggttacctaccgggtaccctaaggttcc

SEQ ID NO: 69892 - DNA, 654 bp, Homo sapiens
  misc_feature: GYAE6OF02JGVAP.51.76.G10.1.454.CMB.1.raw
  modified_base (168)..(168): a, c, t, g, unknown or other
  misc_feature (168)..(168): n is a, c, g, or t
  modified_base (197)..(197): a, c, t, g, unknown or other
  misc_feature (197)..(197): n is a, c, g, or t
  modified_base (253)..(253): a, c, t, g, unknown or other
  misc_feature (253)..(253): n is a, c, g, or t
tcagcgatcgtatacacgaccggtgctcgatttagtcactcatacagggggaggaactgctcagttaggacccagacggaaccatggaagccccagcgcagcttctcttcctctgctactctggcctcccagataccactggagaagtagtgatgacgcagtctccanccacccttgtctgtgtctcgaaggggaancgccaccctctcctacgacgggccagtcagagtcgtagcagcacttgccgtgaccngacagaaacctggccacggcctccaggtcctcctcacttctagttcgagttcgactactaccaacgtaacgggaccctacgtgataccgtcccacgtccgtaacggttacgtacggtcggtacgaggttcggggtacgtaggggacgtaacgtagtttaccaccgttcctaccaaccacgtcacgacgtacgaccgtcgactacgtacgtagtagttacgtttagtaactttagtttacttacttagacgtaccgtaagtagttaacttaaacgtaaccggttcgttaccgttacccgttaacgtttccgtttaccggacggtaacgggaccgtaaggtcggtaaggtcgtaacgtaccgtaaccgtacgttcgtacggtcctagacccttactacgttcg

SEQ ID NO: 69893 - DNA, 802 bp, Homo sapiens
  misc_feature: GYAE6OF02H8CLM.51.76.G10.1.454.CMB.1.raw
tcagcgatcgtatacacgaccggtgctcgatttagtcactcatacagggaggaactgctcagttaggacccagacggaaccatggaagccccagcgcagcttctcttcctctgctactctggctcccagataccactggagaagtagtgatcgacgcagtcctccagcccacctgtctgtcgtcctccggaggggaaagcgcccaccctctcctgcgagggccaggtcagagttgttacgacaggccgacttacgcgtcggtaccacgacgaacgaaccgtcggtaccgacggtcctccccggtacggtcctacccttcgtaacttccgttaacgttaggacgttcggaccttaccgttaccccgaaccgggtaacgggtcccctaacggtaacgtaaccttacccgtacccgaccgttccggttaacgggttaccgtaagggtcggtaccggtcggggtttggttacggtacgggaccgtaggttaccgttcctacccgttaccgtaccaacgtctacgcggaccgactccgtagaccgttagtacgtaggttaactttaaccgtttgtaaacctttaagtttacctttacgtcggttacctaaggttaaccgttaacgtttaaactaaaccgttaccgttaaccgggttacccctttaaccgggttactttaaccggggtttaaccggaccccgggggttagaaacccggttaacggtccgggttaaacggtaccggtaaacgtaaaccggttaacccggtgttaacgggttcccggtaacgacgtacccgttacggtac

SEQ ID NO: 69894 - DNA, 792 bp, Homo sapiens
  misc_feature: GYAE6OF02HKOJQ.51.76.G10.1.454.CMB.1.raw
  modified_base (203)..(203): a, c, t, g, unknown or other
  misc_feature (203)..(203): n is a, c, g, or t
  modified_base (419)..(419): a, c, t, g, unknown or other
  misc_feature (419)..(419): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccgtgtctgtcgtccgtccgaagggggaaancgcccaccctctcctgcagggccaggtcagtacgtgtagacgacgcgtacttacgccgtaggtaacccagaccaacggtaaaccgtcgggaccgtacggggaccccttccccgtaaggggtcccttaccccgttactaacgtttaccgttaagttacgggtaacttccggacctaaccttaacccggaaaccggtaaccggggacctaaccggtanaaaccgttaccctacccggaacggtaccggttaacggttccggtaagggtcgggaaaccgttcggggttacggggttacggtacggggaacgttaacggttaccggttacctccgtaccgttaccaacgttactacgacgtccgacgtccgacggtcgtacgttacgtagttaagttcgttttactacttttaagttttacgttacgtagtaccgtagtacgttaagttaacgttaacttacggttaccggttacccgttaccgtttaacggttaccggttttacgaccgggtaacgggtaccgtacggtcggtaacgtaacggtacctaaaccgtaagtcggttacggacggttcaccgtaccgtacgttcg

SEQ ID NO: 69895 - DNA, 670 bp, Homo sapiens
  misc_feature: GYAE6OF02I455P.51.76.G10.1.454.CMB.1.raw
  modified_base (204)..(204): a, c, t, g, unknown or other
  misc_feature (204)..(204): n is a, c, g, or t
  modified_base (282)..(282): a, c, t, g, unknown or other
  misc_feature (282)..(282): n is a, c, g, or t
  modified_base (398)..(398): a, c, t, g, unknown or other
  misc_feature (398)..(398): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccacgtggaagaagtagtgactgacgcagtcctccagcccacctgtctgtcgtctacggaggggaaancgccctacctctcctgcgagggtccagtcagagttcgttacgcagcgtacgttacgcctggtaccagccaagtaaccnggacctaggcccttaccccgaggtccctacctctacttcgtagtgtaactcgaccacgtaccgaacgtacgggtacctagtacgtaactaccgtcccaggacccttaggttaccgnggtacgcgttagggtcgggttcgacggtacaggttacctcctaacgttccactactacggccacgcgttccgcttcgacgtcggtacgttagtaaagtttcgtttacttaatttaacttttacgtaactcgtagtacttaagtaattaacgtacttaaccggctttaccctaccgttagttccggttaaggaccgtaacgggtcaacgggtaggtaccgtagtaaaccgtaacgaacggtacgttggtaaccgctttcgaccgttaccgtcg

SEQ ID NO: 69896 - DNA, 646 bp, Homo sapiens
  misc_feature: GYAE6OF02JR0GG.51.76.G10.1.454.CMB.1.raw
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (280)..(280): a, c, t, g, unknown or other
  misc_feature (280)..(280): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccacctgtctgtcgtctccgaaggggaacgacgccaccctctccngccgaggccagtccagngtagttgcacgcgtactagcctagtaccagtcacgaacctcggcacgcnccgacgctccgtctactcctatgactcgactacgtaccgaccaacggggacctacgtacgaacttaccgtaccacggaccgtaacggttcgacgtcggacgtagtacggtccgaggtacacgtcgttacaccgtcaccgacacgtacgtacgccacggtcctcacgtacgtactaggtaacgttatttacgaactttacgtttattaacgtgtacgtacgtacgttaagtaacgttaacttacgttaccgtaccttaaccgttaccgttaacgtttacggaccgtaacgggactaaccgggtactaaggtagtaacgtaaccgtaacggtacgttgggtccgtaaccgtggtacctaccggttacg

SEQ ID NO: 69897 - DNA, 707 bp, Homo sapiens
  misc_feature: GYAE6OF02JBRRN.51.76.G10.1.454.CMB.1.raw
  modified_base (197)..(197): a, c, t, g, unknown or other
  misc_feature (197)..(197): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtgtctacgaggggaanacgcccaccctctcctgcgaggccagtacagagtgtagcagcgattacgctggaccagcaacgaaacctggaccacggtccncccgtaggcctaccncatacgtatacgatgacctanaccaacgaaccgggaccaagtgtaactacctaccccgagccttaaggttaccagggtcggtccgaagggtttcgggtacgaggggtaacagggtacttaccaccgtacctacaaccgtaactacgaggaccacgtaccgtgaccgacgttacggtacgtaagttaacgttttagtaacgttaaacgtttttaattaacgttcgtaacgtaacggtacgtaacgttaaagttaaacttaaccgtacgggttacccgttaacgttaacttaacggtttacgggtaccggtaacccggggtaacgtaaaccggtaccgttaacgggtaacggtaagtaaaccgtaaaccgtaacggttacggttaccggaccgttacggtaactacccttaacgg

SEQ ID NO: 69898 - DNA, 773 bp, Homo sapiens
  misc_feature: GYAE6OF02FIVS9.51.76.G10.1.454.CMB.1.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
  modified_base (299)..(299): a, c, t, g, unknown or other
  misc_feature (299)..(299): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtcctccagccacctgtctgtgtctccaggggaancgccaccctctcctgcagggccagtcacgngtgttagcgagcgacttagcctggtaccagcacgaacctgggcctaggcctcccgaggtcctccgtcatctagtnatcgcactccaacgacgggccaacgtcgaataccacccgaggtcccgtaaggttccgaagtcgggtacgaaggggtttcggggtacgtgggtaacgacgggttacggtttccaaccgtttccgtaacccaacccgtagtactaccggaccgtaaccggtacccggtacgaccgtacgttccggttaaacgaacggttttacgtttacgtaacggtttaaaccttttttaaacgttaccgtttaacggtaccggtaacgtaaccgttaaagggttaaaccttaaacggttaaccggttaccggttaaccccgttttaacccgggttaccttttaaaccgggtttacccgggaaccgggttacccggggaaccggttaaccggtaccggttaacgggttaaaccggaacgtaaaacccgtaaaccgggttacgttacgggtagggttacccgtacccggtacccaaccgtttaccg

SEQ ID NO: 69899 - DNA, 815 bp, Homo sapiens
  misc_feature: GYAE6OF02ILUEV.51.76.G10.1.454.CMB.1.raw
  modified_base (154)..(154): a, c, t, g, unknown or other
  misc_feature (154)..(154): n is a, c, g, or t
  modified_base (183)..(183): a, c, t, g, unknown or other
  misc_feature (183)..(183): n is a, c, g, or t
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (252)..(252): a, c, t, g, unknown or other
  misc_feature (252)..(252): n is a, c, g, or t
  modified_base (316)..(316): a, c, t, g, unknown or other
  misc_feature (316)..(316): n is a, c, g, or t
tcagcgatcgtatacacgaccggtgctcgatttagtcactcatacagggggaggaactgctcagttaggacccagacggaaccatggaagccccagcgcagcttctccttcctcctgctactctggctcccagataccacgtggagaagtagtnatgacgcagtctccagccacctgtctgtntcncgagggaancgccnccctntcctgcgaggccagtcagtatgtagcagcgtacttagcctggtaccngacgtaacgaaccgtcggccgaaggttccctacccgaaggtcccttcctcaacgtctactaggntcgacctactacccgaacgaaccgggtcctagtacgtaacctaccgtccgaaaccgtcctaacggtcgaagcgggtcgtaacgggtgggtttaccgaggtacctaggtaccggttttccacccgttactccgtaaccgacgttacgtaaccggccgtaaccggtcccgtagtcctaggggttactaaggtaacgtttacgtttaccggtaacttttaaacgtttacgttaaccgtcggtttacccggaagtaacggttaactttaaacccgtttaaacgttacccgggttaccgggtaacccttttacccgggttaaacggttttaacccgtttccgggggtaaaccgggtacccggggttaaaccggtacccgggggtttaaccgtaacgggggttaacccgttaaaccggttaaaccccggtaaaacgggttttcggaccgggggttttaccggttaccccgggttacccgtaccccggtttaaagttaaccccggg

SEQ ID NO: 69900 - DNA, 843 bp, Homo sapiens
  misc_feature: GYAE6OF02HJMD1.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaagacgcccacccgtctcctgaccgacgggccagtccgaaggtaggttagttacgacacggaccgtacgtttacggccgttacgggtacccaggccaaacggtaaaacccgttcgggacccaagggtcccctaccccgacgggtcccttcccgtactaacgttccgttaagtcggtacttacggaccgtaactaccccgaacggtaaaccggggccctaacgtagtaaccttaccgaccccgtacggtcccgttaacggtttccgagggttcgggaccttacggggtttcgggttaccggtacggggtaacgtaacggtccggtttaccacccgtttaccctaccctaacccgtaacttcccgaaccggtaccgaacggtcccgttacgggaccttacggtttaaccgtaaggttaaacgtttacgtttttacggtaaaccttttaacgttttaactttacgttacgtaacgttaagtaacgttaagtttaaacgttaacgttaccgtaccggttacccgttaaccgttacgtttaaccggtttaccgggaccgtaccgggttaacgtacggtttacggacgggttaagtaacctaaccggtaaaccgtcggttaaccggtggtaccgtaccgtaccgtaccttacgg

SEQ ID NO: 69901 - DNA, 779 bp, Homo sapiens
  misc_feature: GYAE6OF02JTI9P.51.76.G10.1.454.CMB.1.raw
  modified_base (122)..(122): a, c, t, g, unknown or other
  misc_feature (122)..(122): n is a, c, g, or t
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
tcagcgatcgtatacacgaccggtgctcgatttagtcactcatacagggggaggaactgctcagttaggacccagacggaaccatggaagccccagcgcagcttctcttcctcctgctactntggctcccagactaccactggagaagtagtgatgacgcagtctccgagccacctgtctgtagtccaccgaagggaaacncgcccacccttcncctgcgacgggccagtcagtagtgtacgctaggcgtaacttcggccgttaggaccaggtacaacggtaaaacccgtggaccgacgggtacccgtccccgacgggtccctacctacgtattaccgtaagtgtaactcgacctaacggtaccgaaccggaacggtacctacgtagtactaccgtacccgagtcccgttaggtccgtaggcggacgtagggtcgggtacctagggaccgtaggtacgtttacccgaacctcgtaacccggacttcgtacaccggtcgtaaccgtccgtaccggtacgtaacgttcggtaaaggtaactttacgtttgtaaacccgtttaaagtttccggttacgtaaccggtacctaaggtaccgtttaaacgttacgttaaaccgtttaacggtcccgttaaccgttttaacccgggttacctttacgggtttaaccggggaacccggtaacgggtacggaaccgttaacgggtaacggtacgtaaacccggtaaccgttaaaggtccggtacggtcgttaacccggacgttactaacccgttacgg

SEQ ID NO: 69902 - DNA, 571 bp, Homo sapiens
  misc_feature: GYAE6OF02IGPW8.51.76.G10.1.454.CMB.1.raw
  modified_base (197)..(197): a, c, t, g, unknown or other
  misc_feature (197)..(197): n is a, c, g, or t
  modified_base (528)..(528): a, c, t, g, unknown or other
  misc_feature (528)..(528): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttagcagcgacttagcctggtaccagcagaaacctggaccaggctcccaggctcctcatctaatgatgcatccacgaagggccacgtgaatactcccagccgtaggttcgagttggacgtaggttgggtcgtgggacagtacgtttacacttctaccactatcgagcacgtccgtgacacgtactagaagttagtttagtacttaattttacttacgttgtacagtctaagttataagtaacgttcgaccttaccgtacgttacgtttcggaccgtagggacctaaggtcgtaggaanacgttaacaaacgtacgttcggtacggactacgtaccactacg

SEQ ID NO: 69903 - DNA, 858 bp, Homo sapiens
  misc_feature: GYAE6OF02JWM3X.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccacgccaccctgtctgtgtcctccgaggggaaacgacgcccaccctctccgtgacgacgggtccagtcaggagttgttacgcagcgtacttacggccttaggtacccagacctacggaaaccgtcggccacggtccctacccggtaggtacccttccctaccgtataccgtacgtggtaactcggacctaccgtaccccgtaaggaaacccggggtcctacggttacgtaacgttaaccgtacccccgtaacggtacccggtacggtttaccggtaccgggtttacggggacccgggttaagggggtttccgggggtttaacggtacgggggaaaccgttaacggggtttaccgttacccgttacccttaccgttaccaaacccgtaacgttccggacgggtaaccgacggtacctaccggaccgttaacggttccggttaacggttaaacgttttggtttaccttaacgttttaacttttaaccgttaccgtttacggtacgttaacggtactttaaacggtttaagtaaaacccgttcttaaccgggttcccgtttaaccgttaccgttaacgggttttcccgaccggggtaccggggtaccttaacgggggcttaacgggtaccggttaaacgtaccgggttaaacttacgggtacgggtaccgtacccgtacgggttaccaacggtttcc

SEQ ID NO: 69904 - DNA, 768 bp, Homo sapiens
  misc_feature: GYAE6OF02HT52M.51.76.G10.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (264)..(264): a, c, t, g, unknown or other
  misc_feature (264)..(264): n is a, c, g, or t
  modified_base (291)..(291): a, c, t, g, unknown or other
  misc_feature (291)..(291): n is a, c, g, or t
  modified_base (726)..(726): a, c, t, g, unknown or other
  misc_feature (726)..(726): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgggagaagtagtgatgacgcagtctccagccaccctgtctgtgtctccgaaggggaaancgccaccctctcctgcagggcagcagngtnttagcagcgacttagcctggtaccagcaagaaccnggccaggctcccaggctctacatctancgatcgactactaccaacgaacgggcctaactgtatactcccaagtccgtaggtttaccagggttcggactaacgggttcgggtacgttacggggaaactacggtaaacggttttcccaaccgtttaccgttaacccgacccgtaacgttacccgaaggtacccggtaaccgtaccccgttggtaaccctaacgggttcctaaaggtaaacggtttaacgtttttcggtaacccgtttaaaggttttttaacctttaaagttcggtaccgtaacgaaccgttaaacgggaacccgtaaaaacgtaaccggtttacgggtaccccttttaacccggttacggggtaaccggtttacccgggtaaccgggaaaccgggggtaacccgtaaggggtaaacggtaaaccgttaaccggaaaaacgtacggtttaacggnggtacccgtaccgtaaccctaaccgtacgttaccgttaaccg

SEQ ID NO: 69905 - DNA, 1003 bp, Homo sapiens
  misc_feature: GYAE6OF02F2CDS.51.76.G10.1.454.CMB.1.raw
  modified_base (167)..(167): a, c, t, g, unknown or other
  misc_feature (167)..(167): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (991)..(991): a, c, t, g, unknown or other
  misc_feature (991)..(991): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggcctcccagactaccactggtagagtagtgatgacgcagtcnccagccaccctgtctgtgtctcgagggaancgccncctctctgcgacgggccaggtcaggtacgttgttagacagtccgtacgttagccccgttagggtaacccaggtccgtaaacgtaaacccgttgggaccccgtaacgggcccgttaacccccgaagggtcccctttacccccgtacgtaacttttaccggtaagtttaccggaacgtttaccggaccgtaaacccggttacccgaaaaccgggtaaaaccgggggtcccccctaaaaggtttcgggtaaaccttttaaccccgtacccccgacggggtaccccgtttaaaggggttcgttaaacccggggtggggtaccctaagggggttttcgggggtacccttaacggggggaacttaacggtaaccggttttaccccaacccgggtttacctccgaaacccgtttaaccgttaccgaacccgggtaccgaaccgggttcccggtaaaggtcccgtaaagggtttacccgtaaggggttaaagttttaaccggggtttttaaccgtaaccgtttttaaaactttttaacccggtttaaccgtttaccggtttaacccgttaaacggggtaaccttaaaacgggtttaaaacgtttaaaacccgtttaacggttttacccggggtttacccccgttaacccggttttaaacgtttacccggggttttaaagggtacccccgggtacgggttaaacccgtacgggttaacccgtaacggggttaacgtacggttaaacccgtaaacggttaccggttaccgggttacgggtacctaccgggttaaccccngggtttaacccg

SEQ ID NO: 69906 - DNA, 760 bp, Homo sapiens
  misc_feature: GYAE6OF02JBKJE.51.76.G10.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaanacgcccaccctctcctgcacgggccagtcagagtcgttancagcgtacttacgccgtaggtaccagtcaacggaaaccctgggaccaggtccctacccgacggtccttacctcgtaattcctaagtcgtacgtacgtacctaacttcccgaaacgtaaccggggtccctaacgttagaacttaaccgttacccgacggttacccgtaacggtttaccgaacggttcgggtacgtacggttcggggttccgtacggggaacctagggtaacgttttcccgaaccgtttccctacccgaaaccgtacgttaccgtaaccggtaccgtaccggtacccgtcgtaccgtaacgggttaccgtaacggttaaacggtttacgttttacggtaaccgtttaaacgttttaccgttaaccgtttacgtaaccgttacggtaccttaacggttaactaaacgttaccggttaccgtcccgttaccgtaaccgttacgtttacggaccgtacggtacgtacgtacggtacgtagtactacgaacgtagtcggtacgacgtacgtacctactacg

SEQ ID NO: 69907 - DNA, 636 bp, Homo sapiens
  misc_feature: GYAE6OF02FWQVJ.51.76.G10.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (299)..(299): a, c, t, g, unknown or other
  misc_feature (299)..(299): n is a, c, g, or t
tcagcgatcgtatacacgaccggtgctcgatttagtcactcatacaggggaggaactgctcagttaggtacccagacggaaccatggaagccccagcgcagcttctcttcctcctgctactctggctcccagataccactggagaagtagtgatgacgcgacgtcgtccagccacccgtgtctgtgtctccgagggaancgccaccctctcctgcacgggccagtccagagtcgttagcagcgactagcctggtaccngcaagaacctggaccaggctcccgaggctcctcatctatgntgcatccaacgacggccatagactactcccgagtacctaggtcgaggtcggacgtacgggtcgggttcgtacgggaactaggtacgttcctacgttcctaccacgtactacctacggcctacgccctagcctacggtcctaaggtaacgtttagttttacggaacttttaacttttacgttacgttacgtactaccgtactaagttaactaacgttacgtccggttaccttacccgttacgttaccgtttcgggaccgtacgggaacctacggtcgtaacggtaacgaccgtaacgaaaccggttacgtcggtacgcgtaccgaccgtaccgttacg

SEQ ID NO: 69908 - DNA, 758 bp, Homo sapiens
  misc_feature: GYAE6OF02HYHZ5.51.76.G10.1.454.CMB.1.raw
  modified_base (120)..(120): a, c, t, g, unknown or other
  misc_feature (120)..(120): n is a, c, g, or t
  modified_base (250)..(250): a, c, t, g, unknown or other
  misc_feature (250)..(250): n is a, c, g, or t
  modified_base (615)..(615): a, c, t, g, unknown or other
  misc_feature (615)..(615): n is a, c, g, or t
tcagcgatcgtatacacgaccggtgctcgatttagtcactcatacagggggagaactgctcagttaggaccagacggaaccatggaacgcccagcgcagcttctcttcctctgctactcnggctccagataccacgtggagaagtagtgagtgacgctagtcctccgagccctacccgtgtctgtcgtactacggaaggggaacaccgccctacctcgtcctcgcgaggccagtcgagtagtaggttacncgagtcgtacgttacgcgttacggaccaacgaccaacgtaaccgtcggaccgacggtcccgtaccgacggtcctcctacgtactacgttacgtagtacgtacgtacctacgttaaccgacgggtaaaccggtccctacgtacgttaaactccccgtaccgtaaccggtaccggttacgttacgtacgggtcgaccggggttacgggttcgggtacggtacgggtaaccgtaaggttccgtaccggtaccttaccggtactaaacctgactaccggtcccgtagttaccggtcgtaacggtacgttacgtagttttaacgttacgtttacgtttaaacgttttaactttaacgttcgttacggtanacgttaagtaaccgtttaattaaccggtacttaaccggttacccttacggttaccttacggtttcggaaccggtacgggtacctaggtacgaacggttacaacgtaaccgttaagtcgtacggtcctagtccgtacctacgtc

SEQ ID NO: 69909 - DNA, 763 bp, Homo sapiens
  misc_feature: GYAE6OF02FV7OL.51.76.G10.1.454.CMB.1.raw
  modified_base (186)..(186): a, c, t, g, unknown or other
  misc_feature (186)..(186): n is a, c, g, or t
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
tcagcgatcgtatacacgaccggtgctcgatttagtcactcatacgagggggaggaactgctcagttaggacccagacggaaccatggaagccccagcgcagcttctcttcctcctgctactctgcctcccagactaccactggagaagtagtgatgacgcagtctccagccacctgtctgtgtcncgagggaanacgccacctctctgccagggccagtcagagtgtagnagcgtacgttacgccgttaggaccagccaacggaaccgtggccaagggtccctacccggacggtcctccgtacacttactacgtggaactcgacctacgtacccgaaacggaacgggtaccctaacgtacgtaactacccgtacccgaacggtcccgttaaggttacgtaagggtccggcgtaacgggttcgggtacggtaacgggtacgtaacggtacttacccgaccttcccgacctacgtacgtaccaggacctaccgtccgttcgacgtacgttcgtaaaggttaactttagttaacgtatttaaagttttaccttacgtacgttagaaccgttagtaacgtttaactaaacgtaaccgttaccggtacccgttttaacccgtacgtttacccgggtttacgggacccggttaacggggacctaacggggtacgttaacgggtaaccggtaaaccttaaccgggtaaaacggttacccggtttacgggtacccggttaacggtaccggtaaccccgtacggttaaccc

SEQ ID NO: 69910 - DNA, 740 bp, Homo sapiens
  misc_feature: GYAE6OF02FJVLZ.51.76.G10.1.454.CMB.1.raw
  modified_base (463)..(463): a, c, t, g, unknown or other
  misc_feature (463)..(463): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgaaggggaagcgccaccctctccgtgcgacgggccagtcgaggtcgttgtacgcacggcgtacttacgcctggtaccagacacgaaaccgtggccacggcccctaccccgaggtcccttcccgtactaacttcgtaacgtagactcgtacctaactacccgaacgggtaaccgggacctaacgttcgtaactaacctcccgaacggtccgtaacggtttcaggttcggacgtagggtcgggtacgtgggtacagttcggttccacttccgactaccncgtacgtacgactaccgccgtgtaccgtacgtacgttaaggtacgtttattttaaccggtaacttttaacgttttacgtttcgtacggttacgtaactaacggttaacgtttaaagtttaacttaaccggttaccgtttacccgttaaccgtttaccggttaccggttttacccggaaccggtaaccgggtaccgtaaacggtcggtaacgggacgttaaacgtaaccggtaaaccgtcggttacggtaccggtacctccggtacctacccgttacg

SEQ ID NO: 69911 - DNA, 829 bp, Homo sapiens
  misc_feature: GYAE6OF02GQLLL.51.76.G10.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccacctctcctgcagggccagtcagagtgttaancagcgtacttagcctaggtaccagcaacggaaacctggaccaggcctacccgaggcccttcctacgattacctaagtaggactcggactaactccccgaaacgaacgggcctaacgtaggtaactaaccgtaccccgaaggtacccgtaaggtttaccaaacggggttcggacccggttaagggttcggggtaccgtaacggggggtaacctaacgggttacggttttaccaaccgtttcccggtaacctaacccgtaacgttaccgtaacggacccggtaacgtacccggtaccggtaccgaacgttaccggttaaggtaaacggtttaacgttttaaccggtaacttttaaaacgtttttaacgttaaccgtttacgtaacccggtaacggttaaccgttaaacggtttaaacgtttaaaacgttaaacccggttacgggttaaccccgtttaaccggttaaacccgtttaaccggttttaccggggaacccgttaaccgggggtaactaacgggttacgtaagggtaaccgtaacgttaaccggaaaacgttacggttacggtaacgggttacctacggtaccaccgttacgg

SEQ ID NO: 69912 - DNA, 691 bp, Homo sapiens
  misc_feature: GYAE6OF02GMA20.51.76.G10.1.454.CMB.1.raw
  modified_base (197)..(197): a, c, t, g, unknown or other
  misc_feature (197)..(197): n is a, c, g, or t
  modified_base (339)..(339): a, c, t, g, unknown or other
  misc_feature (339)..(339): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcacgggccagtcagtagtgttagcagcgacttacgcctggtaccagcaagaaaccgtggaccaggcctccccgaggcctcctcacttcgtatgatcgaccataccaacggacggccacgtgactacncccgagccgtagttcgaggtcggacgtaggtcggtcgtgggactaggtacgttaccacgttacctaccgaaccgtacgtaccgtacgaccgaccgtccgtacgccgtaacgttaccgtaggtaagtttacgtttacgtaactttaacttttacttacttacgttacgaacgtacgttaacgttaagttaaacgttaaccgtacgttacccgtttaacccgttaaccgttaccgttttaccgggacccggttaaacgggtaccgtaaacggtcggtaacggtaaccggtaacgttaaaccggtaaaccggttacgttacggtaacggtccgtaccgtaccgtaccgttaaccg

SEQ ID NO: 69913 - DNA, 1039 bp, Homo sapiens
  misc_feature: GYAE6OF02I4QFL.51.76.G10.1.454.CMB.1.raw
  modified_base (218)..(218): a, c, t, g, unknown or other
  misc_feature (218)..(218): n is a, c, g, or t
tcagcgatcgtatacacgaccggtgctcgatttagtcactcatacgaggggaggggaactgctcagttaggacccagacggaaccgaatggaagccccacgcgcagcttctcttcctcctgctactctggctcccagataccacgtggagaagtgtgatcgacgctacgtcctaccgacgccctaccttgttctcgtacgtacgacggacgggaaacnccgtcccacccgttcgtccgtggaccgtaagggcctaggtaccgtaaggtaggttacggttaacggacccgtaaggttacccgtaaccgtttaacggcccgttaaacgggtaaccctaacgaccgtaaaccggtaaaccccggtcgggaccccggaaccggtccccttaccccggtaagtcccttacccacttaacgttcttaacggcgaccgttcgacctacgaccgaaacggaccggccaacgtcgtaacgtaccgtacccgtacggtacccggtaacgggtttcggacgggtacgggaccgtttaacggggtttcccggggttacgtacggggtaaacctaacgggtttacccggttaaccctaacccttacccggtaacgtaaccccggttaacgttaccgggtaaacccggtaaaccggttttaacccggtcccgtttaaacgggtacccgttttaaaccgggtttaaccggtttaacgggttttaaacgggttttaccgttttttaacgaccggttttttaaaacctttttaaccgggttaccggttttacgtaaacggggttaccgttaaccggtttaaaacgggtaaaccgggttttaaacccgggttacccgggtttaaccggggtaaaccccgttttaaccggtttaaacccggtttaaacgggggtttacccgtaaacccggggggaaccgggttaacccttaaagggggtcccggttaaccggtttaaacggtaaccctttaaccccgggaaattttacccggtcgggtttaaccggtacccttaacccggttaccgaacccgttttcg

SEQ ID NO: 69914 - DNA, 632 bp, Homo sapiens
  misc_feature: GYAE6OF02JRWKT.51.76.G10.1.454.CMB.1.raw
  modified_base (158)..(158): a, c, t, g, unknown or other
  misc_feature (158)..(158): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagtagtagtgatgacncagtctccagccacctgtctgtgtcctccgaaggggaancgcccaccctcncctgctacgggccagtcagtgtgtacgcagcgtatcgctggacngcacgaactgacngctccngtctcgtacntctagtnactgctacaccagacgggtcctatagtacgtaacctccgaactccgtacggttcacggtcgaccgtggttcggtcgtacgggtaatacggtgttaccaccgttctaccgtacgtaccttacgaaccgacgttaccgcctacgtcgtacgtaccgtaggtaatttacgtttagtaacccttttaagttttacgttaacctcgggtttacccaaggttactaaggttaactaacgttaccgtcggtaccttacgttaacgttaccgttagaccggttacgacgtcggtacgtacggtagtaccgtaacgtaaggttacgcggtagtaccgtctaacggtcctacg

SEQ ID NO: 69915 - DNA, 770 bp, Homo sapiens
  misc_feature: GYAE6OF02JCO7G.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctccagataccactggagaagtagtgagtgacgcagtctccagcccaccgtgtctgtcgtctacgaagggaanacgccacctcgtacctgacgacgggcagtcagagtagtacgacacgcgtactacgccgtaggtacacgacaacgtaaccgtcggaccaggtccctacccgaggtcctcctacgtacttactacgtagaacgtcgaacctaccgtaccgaacggaaccggtacccgtaacgtagaaccttacccgtacccgtaacggtaccgttaacggtactaagggtccggacgttaacgggtcggggttaacggtacgggaacgtaacggttaccgttacccgaccgtacctaacccgaacgtacgtaccgtaagaccgtaccgtaccgtacgtaccgtatacggtaacgttaacggtttctttaacggtaactttaaacttttacggttaacgttggtaaccgttaagtaacgttaaagtttaaaccgtaaagttaaccggtaccgttacccgttaccgtttaaaccggttacggttaaccgggtaaccgtaacggggtaacctaacgggtcgtaaggtaacgtaaacgtaaccgtaaaagtccggttaggtccgtaacgtaccgtacctacgttacg

SEQ ID NO: 69916 - DNA, 675 bp, Homo sapiens
  misc_feature: GYAE6OF02I6SJS.51.76.G10.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (374)..(374): a, c, t, g, unknown or other
  misc_feature (374)..(374): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgcagtctccagcccaccctgtctgtgtctccgaggggaaacngcccacccgtctcctgcgngggcctagtcagagtgttagcagcgactgcctggtaccagcaagaacctggacccaggcctcccgaggtcctcctacagttctagtgtactgacctactaccgaacggacgggcctactgacttacgcccacgacccgtaggttccaggtcggntacggggtacggtcctaggggactaggtacgtttcccaccgttacctaccgaccgtactaccgacgtccggtaaccgtccgtacgccgtaacggttcgtaacggtaaggtttacgttttacggtaaccgttaactttttacgttaccgtttacggtaccgtaagtacgttaacgttacttaaacgttacgtccgtacccgttaaccttaccgtacgtttacggaccggtacgggtaacgtcggtcggtacggagtacgtaacgtaacgttacgcgggttaccgacgtcgtaccgacctacg

SEQ ID NO: 69917 - DNA, 957 bp, Homo sapiens
  misc_feature: GYAE6OF02GP7YR.51.76.G10.1.454.CMB.1.raw
  modified_base (225)..(225): a, c, t, g, unknown or other
  misc_feature (225)..(225): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagactaccacgtggaagaagttagtgagtcgacgactagtcctccgaccgaccctaccctgttctgttccgttaccgtacggaaaggggaaacnccgtacccctacccgtccgtacccgtggaccggaccgggaccttacggtacgaaggttcggttaaggttacgacgtacggtaccgttaacgttccggccggttaacggtaaccgagaaccgaaaccggtaaccgcggaccgacgtccccgtaacccgcgtccctttaccacttaacgttacgttacgtacggttacaccgtaaccgtccgaaaccccggaaaccgggttaccggaaccccttaaacccggttaagttaaaccccgttaacccccggtaacccccggtaccggtttaacccgggtttaacgggttacggtaaccgggggttccgggttaaccgggtttacggggggtttccggggtttaaacggtaccggggttaaaccggtaaaccggttttcccggtttaccctaaacccggttacccctttaacaacccgtaccgtaaccggtaccgtacccgtaccggtaccgtaccgtacgttaacggttacgttaaggttaacgttttacgtttaacttaaacgtttttactttaaacgttcggtacgtaactaacgttaacgttaaacttaacgtaaacgtttcccgttaccggttaccgtttaaccgtttaacgttccggttaaccgggtaccggtaaccgggaacgtacggtggtaaacgtacggttaaacgtaacggtaaccgttacggttacgtaccggttacaccgtaccgtaacgttccg

SEQ ID NO: 69918 - DNA, 592 bp, Homo sapiens
  misc_feature: GYAE6OF02IGCGU.51.76.G10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (294)..(295): a, c, t, g, unknown or other
  misc_feature (294)..(295): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctccagccaccctgtctgtgtctccaggggaaangccaccctntacctgcagggccagtcagagtgttagcgagcgacttagcctggttaaccaggcaagtaaacctggaccaggctacccagctcctacnannancngntagcatcancgtacagngtacagtgctgaangtacncgcgtancgtacacgacgtacgacgacgtacgaacgtacgacgtacgtaacgtacgtacgaaccgtagtacgtactacgtacgtacgtacgtacgtacgtacgtacgtacgtacgtacgtacgtacgtacgtacgtaacgtacgtaacgtacgtacgtaaccgtaacgtacgtacgtacgtaacggtaacgtaacggtacggtaaccgtaacgtaacgtacggtaccggtaacggtacgtacgtacgtacgtacg

SEQ ID NO: 69919 - DNA, 775 bp, Homo sapiens
  misc_feature: GYAE6OF02IL1FC.51.76.G10.1.454.CMB.1.raw
  modified_base (204)..(204): a, c, t, g, unknown or other
  misc_feature (204)..(204): n is a, c, g, or t
  modified_base (526)..(526): a, c, t, g, unknown or other
  misc_feature (526)..(526): n is a, c, g, or t
tcagcgatcgtatacacgaccggtgctcgatttagtcactcatacaggggaggaactgctcagttaggacccagacggaaccatggaacgccccagcgcagcttctcttcctcctgctactctggctcccagataccactggagaagtagtgatagacgcagtctccagccctacctgtctgtcgtcgtaccgaaggggaaaanccgacccacccgttacctccgtcggaccgacgggaccctacggttacgaaggttacggttacggtttaacgaccgtacggtaccgtaacgttaccggtaccggttaacggtaacccgacggtaacaaaccggtaaaccgtaccgggtacccgaacgtaccccgtacccggtaacggtccttacccgtacgtaacgttaccgtagtaacgtacgtcgaacctactaccgacgaacggcctaacgtagtaactacccacggtaccgacgtaggtcaggcgacgtagggtcggcgtaaggctagtacgtctactactcaaccgtntaccgacgcgtacaccgtagtacgtagtcgtaacggtatttacgttaacgtaacgttttattaaccgtttaacgtcgtaacgtaagttaccgttaaaggttactaaacgttaccggttacgttaccttaccgttacgtttaaccggttacggaacggtacgttaaaccgcggttacggtaacgtaggtaaacctaacgttaaccggtcggtttaacgccgggttaacctcggaacccgtttatacccgg

SEQ ID NO: 69920 - DNA, 664 bp, Homo sapiens
  misc_feature: GYAE6OF02JVM7H.51.76.G10.1.454.CMB.1.raw
  modified_base (195)..(195): a, c, t, g, unknown or other
  misc_feature (195)..(195): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (462)..(462): a, c, t, g, unknown or other
  misc_feature (462)..(462): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagcccacctgtctgtctctaccgagggaancgaccaccctctcctgctagggcctagtccagtagtcgttacgngacgcgtacgttanccgtacggtaccgagcgaacgaaaccgtcggaccgacggacctcccgacggtcctccgtacgtactactacgtacgtacgtccgccgactaccgaacgtaaaccgggtccctaacgtagtactactacccgacgtccggtaacgttcgtaacgtcgtacgtacgggtcggtacgtacggtacacggtacgttccgtacgtcgttaaccnccgtacgtaccgtacgtacgtccgtaccgtcggtactacgttacccgtagttaacgttcgtttacgtattacttacgttatcgtagtaacgtactagtaacttacgacgttccgtacgttactacgttacgtacgtacgacgactaggacgtacggtacacgttacgaaccgtacgtcggactacgttcgaccgtacgtacg

SEQ ID NO: 69921 - DNA, 710 bp, Homo sapiens
  misc_feature: GYAE6OF02H59KM.51.76.G10.1.454.CMB.1.raw
  modified_base (202)..(202): a, c, t, g, unknown or other
  misc_feature (202)..(202): n is a, c, g, or t
tcagcgatcgtatacacgaccggtgctcgatttagtcactcatacagggggaggaactgctcagttaggacccagacggaaccatggaagccccagcgcagcttctcttccctcctgctactctggctcccagataccactggagaagtagtgatgacgcagtctccagcccaccctgtcctgtgtctccgaagggggaaanacgcccaccctctccgtgcgacgggcccagtcagtagttgtaacgcagccgtacttacggcctaggtaccagacgtaacgaaaccgtcggaccgacggcctcccgacggtcctcctactactacgtatgatcgactactaccaacggaacggtacctacgagtactaccgtaccgaccgtaccgtacggttacgaacggtggaccggtaggggttcgggtcgggacggtaacggtaggtacgttacctacgttccctacctaaccgactacgacggaccgtacgtcccgtgtaccgtacggttacgaacggttaagtttagttttaccgttaacgtttaaattttacgttacgtcgtaaccgtagtaacgttaattaacgttaaactaccgttcgttacccgttaaccgtacgtttacgttcccgggaacggtaccggtacgtaacggtggtaacggagtaaaccgtaacgaaccggttgtacggtcggacctacgtaccctagtccg

SEQ ID NO: 69922 - DNA, 630 bp, Homo sapiens
  misc_feature: GYAE6OF02G5OYU.51.76.G10.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
tcagcgatcgtatacacgaccggtgctcgatttagtcactcatacagggggaggaactgctcagttaggacccagacggaaccatggaagccccagcgcagcttctcttcctctgctactctggcctcccagactaccactggaagaagtagtgatggacgcagtctccagcccacctgtctgtgtactcgaagggaaancgccacctcnctgcgaggccagtcagagttgtancgngcgtattacgctaggtaccagacaacgaaccgtggaccaggcctaccgaggcctacctacactacgtatgtancgactataccgaacgaacggtcactagactacgcccgagaccgtagttaccagggttcgacgttagggtcggtacgagggactaggtaccttacacgttccgaacgaccactacgaagaccgtacgtcctcgacctaacgtcgtaaggtaaaccgttaggttttaacaacgtttaagtttacgttacgtcttaacgagtaacgtaattattaaaccgttacgtaccgtaccgttccttaacgtcgtttacgaccggtacggtaacgtacgtcggttaagacgaacgtacgtaaacgtcgtcgtaggtcaggacctatacg

SEQ ID NO: 69923 - DNA, 744 bp, Homo sapiens
  misc_feature: GYAE6OF02I3BNX.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccacctgtctgtgtctacgaggggaancgccacctcgtcctgcagggccagtcagtacgtgtagcaggcacttagcctaggtaccaggcaacgtaaccgtggtccaggtcctacccgaggtcctccttacgacttcgtaagtcgagtcgacaacgtcccggaacggaacgggtcccaacgttaggtaacttaccgtaccccgaaggtaccccgtaagggtttaccgaaggtttccgggaaccgtacggggttttacggggttaccgtaaggggggaaaccttaacggggttaaccggttttaccctaacgttcccggtttaaccaacccgttacgttaccgacggtaaccgaccggttcccgtacgaccggttacggttacgttaacggtaaacgtttacgtttacgtaacgtttaacgttttacgttacgtttacgtaccgttaacgtacgttaacgttaacgttaacgttacggtacgttaccttaccgttaacttacgttacggaccgtacggacgtacgtacggtagtacgtaagacgtaacgtacgtacgtcggtactaccgtcgtactacg

SEQ ID NO: 69924 - DNA, 741 bp, Homo sapiens
  misc_feature: GYAE6OF02FK71X.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtcctgtgtctccaggggaaanagccaccctctccgtgcagggccagtcacgagtgtagcagcgacttagcctggtaccagcagaacctggccaggctccaggcctccgtcagtctatgatgcaatccacgaacggccacgttagactactcccgagtccgtagggtttcaaggtcggtacacgggtacgggttacgtagggggtaacctagggggtacttttcccaaacgtttccgaccaacccgtaacgtttcccaaacggtcccgaaaccggtccccgtttacgggacccctaaacgggtttccgttaacgggtaaaaaccgtttaacggttttttaccggaaacccgtttaaaacggttttttactttaaaccggtttcggttaaccttaacggtaccgtaagtttaaacgttaaacttaaacgttccggtacccgtttacccgttaaaccttaaccgttttcgggacccttaacggggtacccaagggttaccagggaactaccttaaccggaaaacggacgtttcggtacggccgttaaccggactaacccgttaaccg

SEQ ID NO: 69925 - DNA, 646 bp, Homo sapiens
  misc_feature: GYAE6OF02FNTIE.51.76.G10.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccgaggggaanacgccaccctctcctgcgacgggccagtcagagtgttagcagcgacttagcctgtaccngcagaacctggcagctccgagctccnatctangatgcanccgacgaacggcctagtgactactacccagcccgtaggttcgaggttcggcgtagggttcgggtcgtaggggaacgtaggtacgttaccgaccttaccgtacctaacctacttaccgacgtaccgaccgtccgtacgccgtaggttaccgtagtaaggttacgttttacgactttaacgttttaacttacgttcgtacgacgtacgttaataactttaaaccgtacgttcggttacccgttaccgtttacgttacgttttccgaccgggttacggaaccgtacggtcgtaaggtaccgtaacgtaaccgaaacgttacggtacgtagggtaccgtacgaccctacgttacg

SEQ ID NO: 69926 - DNA, 634 bp, Homo sapiens
  misc_feature: GYAE6OF02FSDSW.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggaaanagccaccctctcctgcagggccagtcagagtgttagcagcgacttagcctggtaccagcagaaacctggaccaggctcccaggcctcctcatctatgatgcactccacaacgggccacttgatactcccagccgtacggttcaggtcggacgtaggtgggtcgtgggacaggtacgtttcacgttcctcaccgtataccgagcgacgtccgtgaccgtacgtcgttaggtaagttacgttttagacttaactttacgttacgttgtacgtacgtacgtaagttaacttaaacgttaacgttacggtacccgttaccgttaacgttaccggttttcggacccggtacggggtaacccgtacggtacggtaaggtaaccggtaacgttaacggtaaacggtaccggttaggtaccggtacgtacgtaccgtacgttaccg

SEQ ID NO: 69927 - DNA, 737 bp, Homo sapiens
  misc_feature: GYAE6OF02JMS9R.51.76.G10.1.454.CMB.1.raw
  modified_base (183)..(183): a, c, t, g, unknown or other
  misc_feature (183)..(183): n is a, c, g, or t
  modified_base (200)..(200): a, c, t, g, unknown or other
  misc_feature (200)..(200): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcgagtctccagccaccctgtctgtntccgtccgaggggaaanacgccgaccctctcctcgcgacgggcctagtcagagtgttagcagcgtacgttacgccgtcggtaccagcaacgaaaccgtcggaccgtacggcctacccgaggtccttcccgctactcgtatgacgtcgcctacgtaaccgaacgacggtcctaacgtacgacttaccgtccgacgtaccgtacggttacgaacggtcggacggtacgggttcgggtacggtacggggtaactaggtaaccggttccaccgttccggtacccaccgtaacgtccgaacggccgtaccggtaccgtcggaacgttaggttaccgttaagggtaactttagtttacgtaactttaagtttttaacgtcgttttacggaccttaacgtacgttaagttaaacgttaacgttaccgttccggttacccgtttacctaacggttttccgtacggtacccgtacggggaactaccggtacggtaacggtacgtaaccgttaacgtaaaaccgggtcgtttacgggtccgtacgtacgtaccctacggtaccg

SEQ ID NO: 69928 - DNA, 679 bp, Homo sapiens
  misc_feature: GYAE6OF02FE278.51.76.G10.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctccgagggggtaaancgccaccccttntcctgcacggggccagtcagtagtgtacgcagccgacttagcctggtaccagacacgaacctggcccaggtccctacccgaggtccttccctcagttactagtcgtatcggcactaccgacgtaacgggcctaacgtgtaactactcccgaggcctaggttccacggttgggcctaggtcgggtcgtagggactagtccgttactaccgtctaccgacctactaccgacgccgtacgcccgttgaccgtagtcctaggtaacgttagtttacgtactttaacttttacgttacttcgttacgacgtacgtaagttaacgttaaacgtaacgttacgggtacccctttaccgttaaccgttacggttttacccgggacccggtacggggtaaccaacgggtacgtacgggtaacgtaacgtaaccgtaaacggtacgtacggtacggtccgtacgtacctaccgttac

SEQ ID NO: 69929 - DNA, 918 bp, Homo sapiens
  misc_feature: GYAE6OF02HU9AT.51.76.G10.1.454.CMB.1.raw
tcagcgatcgtatacacgaccggtgctcgatttagtcactcatacgaggggaggaactgctcagttaggacccagacggaaccatggaagccccagcgcagcttctccttccctctgctactcgtcggcctcccagactacccacgtggaagaagttaggtgatggacgcagttccaccagcccaccctgtcctgttacgtcctaccggaaggggaaacaccgaccctaccctcgtccgtacgccggacggacctagtaccgaggtacggttgtagaccgtaaggaccgttacgttacgccgtacggtaaccaacggacaaaccgaaaccgtcgggaccgtaccggacctccccgaggtacccctccgtacgtaacttacgtaattacggtacgttacccgaccgttaactaaccccggaaacccgggaaaccggttcccgtaaacgttaacggtaaaccctaacccccggacccgtaacccggtttaacccgggtaaggtttacccggtagggtttaccgggtacgggttacgggggtttacgggtacggggttaacggaaccggttagggtttaaccttttacccccgaccgttaaccgtttaaccgaacccgttagttacccggaagtacccgggtacctccgtaggttaacgtagttaccggttaaggtttacttttacgtttaccgtttaaagttttaacttttaaacggttcttaacgggtacctaaggtaaacgtttaaacgttaagttaaaccgttacgggttacccgttaaccgtttaacccgtttaaccggttttaccggggttaccggaacccgggttaacggggaccgttaaggttcggaaccggtattaaccggaaaccgttaacgcgtttcggggaattccccgggtaatacccggtagtttcg

SEQ ID NO: 69930 - DNA, 674 bp, Homo sapiens
  misc_feature: GYAE6OF02JMD3C.51.76.G10.1.454.CMB.1.raw
  modified_base (356)..(356): a, c, t, g, unknown or other
  misc_feature (356)..(356): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtcctccagccaccctgtctgtgtcctccgaggggaacacgcccaccctctcctgccgagggccagtcgagtacggtagttacgcgagcgtacttaggccttacggtaccagaccgaacgaaccgtggacccaggcctcccgaggcctcctacactctacgtgactcgctactccaacggtacggccatcgactacncccagtaccgtaggttcgaggtcggcgtaggtcggtcgtgggaactacgggttactaccgtacgtccgtaacgaccacgtaccgtacgaccgacgtcccgtagacgtaacgttacgtacggtaagttagtttacgtacgtttaacttttacgttacgtacgtacctagaccgttaatacgtaaataacgtcgttaccttaccgttaacgttccgtttacgggaaccggtagggaaccgtaggtaaccggttggtaaccgtaaccgtaacggtaaccttacgggtacctacgggtacctaccgtacgtaaccttaccgg

SEQ ID NO: 69931 - DNA, 684 bp, Homo sapiens
  misc_feature: GYAE6OF02HQKUP.51.76.G10.1.454.CMB.1.raw
  modified_base (370)..(370): a, c, t, g, unknown or other
  misc_feature (370)..(370): n is a, c, g, or t
  modified_base (534)..(534): a, c, t, g, unknown or other
  misc_feature (534)..(534): n is a, c, g, or t
  modified_base (548)..(548): a, c, t, g, unknown or other
  misc_feature (548)..(548): n is a, c, g, or t
  modified_base (648)..(648): a, c, t, g, unknown or other
  misc_feature (648)..(648): n is a, c, g, or t
  modified_base (664)..(664): a, c, t, g, unknown or other
  misc_feature (664)..(664): n is a, c, g, or t
tcagcgatcgtatacacgaccggtgctcgatttagtcactcatacaggggaggaactgctcagttaggacccagacggaaccatggaacgccccagcgcagcttctcttcctcctgctactctggcctcccagactaccactgggaagaagtagtaggatcgacggcagttctccagcccaccctgtccgtgttcgacctccggaaggggaaacgcgacccacctcctccgtggacgacgggccagtacgagtaggtacggttagaccacggtaccgtacgttaccgccgttacggaacccgagacgaaacgtaaccgtcggaccgtacggcctaccccgaggtccttccacgtactactagtacgtacncgaacctcgtacccgaacggaaccggtacctacgtataacttactgaccggaaccgcgttaacggttccaaggcgtacgtaggtttcggggcgtaggaactaagtcgtaaccgcttacgcctacacgtacggaactcgacgttcgacttggacttcggttaaanaaggtttcctttanaaccgttttaaatttacggtcctaagttccgacgacaagggtaaccctaacgtagtgtacctttcggtacgttccggggaggagtacgtacgggaacganaaactacggtatcggntaccggatacaccgttatcg

SEQ ID NO: 69932 - DNA, 652 bp, Homo sapiens
  misc_feature: GYAE6OF02HEKTB.51.76.G10.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
tcagcgatcgtatacacgaccggtgctcgatttagtcactcatacagggggagaactgctcagttaggacccagacggaaccatggaagccccagcgcagcttctcttcctcctgctactctggctcccagataccactggagaagtagtgatgacgcagtctccagcccaccctgtctgtgtctcgaaggggaangcccaccctctcctgccagggccagtcagngtgtagcagcgacttagcctgacagcagaaacctggccacggcctcccgaggacctcctcactctatgactgcatccacgaacgggcctactagactacgtccacgccaggtttcagtgctaggtggtctgggactagtacggttacacgtcctaccaccgtatacgtacgacctaggacctcggtactacggtcctaggtaagtttaacgttttacggtaacttaagttttaacgttaacgttacgtacgtaacgtaactaaggttaaactaaacgttaacgttacgggttacccttaccggttaaccgttaacgttttacgggtaccggtaccgggttaaccgtaacgtacgttacgggtaacgtaacgtaaacggtaaaccgtaagttaccggtagtacccggtacggtacctacttaaccgg

SEQ ID NO: 69933 - DNA, 652 bp, Homo sapiens
  misc_feature: GYAE6OF02F4522.51.76.G10.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctcncctgcgagggccagtcagagtgttagcagcgacttagcctggtaccagcagaacctggcctaggcctcccgaggtctcctcatctatgacgtgacactccaacgacggcctaagtgactacgtcccagtcctaggtacaggtggacctagggtcgggtcgtaggggaactacgggtacttaccgacgtcctaaccgaacctactaaccggagtacccaacggtcccgttaggaccgtaacggttgtaaccggtaacgtttagttttaaccggacttttaaacgtttacttaccgttagtaccgtagtactaagttaactaaactacggtcggtaaccttcccgtaacgtttaccgttcggacccgtacgggaacctaacggcgtacgggaataaccgtaacggaaaccgttacggtcggtacggtacctcggtaacctcgtacg

SEQ ID NO: 69934 - DNA, 762 bp, Homo sapiens
  misc_feature: GYAE6OF02HIGE6.51.76.G10.1.454.CMB.1.raw
  modified_base (145)..(145): a, c, t, g, unknown or other
  misc_feature (145)..(145): n is a, c, g, or t
  modified_base (209)..(209): a, c, t, g, unknown or other
  misc_feature (209)..(209): n is a, c, g, or t
  modified_base (238)..(238): a, c, t, g, unknown or other
  misc_feature (238)..(238): n is a, c, g, or t
  modified_base (305)..(305): a, c, t, g, unknown or other
  misc_feature (305)..(305): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactgganaagtagtgatgacgcagtctccagccaccctgtctgtgtctacgagggaaatacgcccaccctntcctcgcacgggccagtcagacgtgttancagcgacgttagcctggtaccagacaaacgaaaccgtcggaccaaggccctacccgagccttacccnctattacctaagttgaatcgacgtactaccgaacgtaacggcctacgtagtactactcccgagtccgtaaggttccaaggttcggacgtagggttcgggtcgtacgggaaacgtacgggttactttaccaccgttccgtaacctaaccgtacgtaccgaacgtaccgacggtaccctaggtaccgtacgttaacggtaaggttaaacgtttacgttttaagtaacctttaaagtttttaacgtacttacggtacgtaacgtacgtaaagtttaaacgtaaacgttaccggttacgttaaccccttaccgttttaaaccggtttcgtttttaaccggggaacccgggttaagggggaacccccttaagggtccgttaacgggtaacgtaaaacccgttaacggaaaacccggttagttaccgggtaccgttaacggtacgtaacccgtacttaaccgg

SEQ ID NO: 69935 - DNA, 683 bp, Homo sapiens
  misc_feature: GYAE6OF02HWN8C.51.76.G10.1.454.CMB.1.raw
  modified_base (197)..(197): a, c, t, g, unknown or other
  misc_feature (197)..(197): n is a, c, g, or t
  modified_base (238)..(238): a, c, t, g, unknown or other
  misc_feature (238)..(238): n is a, c, g, or t
  modified_base (334)..(334): a, c, t, g, unknown or other
  misc_feature (334)..(334): n is a, c, g, or t
  modified_base (415)..(415): a, c, t, g, unknown or other
  misc_feature (415)..(415): n is a, c, g, or t
tcagcgatcgtatacacgaccggtgctcgatttagtcactcatacaggggggaggaactgctcagttaggacccagacggaaccatgggaagccccagcgcagcttctcttcctcctgctactctggctcccagataccactggagaagtagtgatgacgcagtctccagccacctgtctgtcgtctccgagggaanacgcccaccctctcctgcgagggccagtcagagtgttagcngcgtacttagcctggtaccagcaacgaaccgtggccaggcctaccgaggtcctcctcatctatgatcgctactccgacgaacggcacgtgactacnccagcctaggttcaggtcgacgtggttcggtcgtacgggaacaggtacgttcacctcctacgacctagtcaacgccgtacncccgtgactaacggttcgtaaggtactttagtttacgtaactttaacgttttacgtttagtcgttacgtaagtacggttaaattaaacgtaaacgtttaccggtaccggttaaccctttcccggtttaaaccgtttaccgttttaccgggggaaccccggttacggggttaacctaaccgggttccggaaggtttacgaaaaccgttaacgggtaaacccgttaggttcgggttacccggatttaccccggaacgtacctttaccggg

SEQ ID NO: 69936 - DNA, 697 bp, Homo sapiens
  misc_feature: GYAE6OF02IGV0D.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctccacgccaccctgtctgtgtctccgaggggaancgcccacctctctgcgaggccagtcagtagtgttagcagcgtacttacgtccgtaggtaccaggacaacgaaaccgtcggaccgacggccctcccgacggtcctcctcacttccgtaagtcgactcggacctactccgaacgaacgggtcctaacgtcgtaacctacctcccgaagtccgtacggtttcgaggtcggcgtacgggttcgggttacggtacgggactaaggtacgttcccgacttcccgtactaccgtacgttacgacgccgaacggtccctaggtacctaggttctaaggtaagttcttttacacgtttaattttacgttactcgtacgtaagacttaacgttacttaacgtaaccgtcggtaccttaccggttaagttccggtttcggggaccgtagggtacccgtaaggtcggtaacggacgggtacttaaacccggaaaacggttacgttcggggtaccggacgttcccgtaaccgtacttaccgg

SEQ ID NO: 69937 - DNA, 633 bp, Homo sapiens
  misc_feature: GYAE6OF02GYDMP.51.76.G10.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (450)..(450): a, c, t, g, unknown or other
  misc_feature (450)..(450): n is a, c, g, or t
tcagcgatcgtatacacgaccggtgctcgatttagtcactcatacaggggaggaactgctcagtttaggacccagacggaaccatggaagccccagcgcagcttctcttcctcctgctactctggctcccagactaccactggagaagtagtgatgacgcagtctccagccacctgtctgtgtctccgaggggaaancgccaccctctcctgcgagggccagtcagagtgtancagcgacttanccgtaggaccagcacgaacctggaccaggtcctcccgaggtccttccgactaactcctaatgtactcgctacctaccgaacggaacggccagtacgtaactccgacccgagtccgtacggttgacggtgcgtaggtcgggtacgagggactaggtcgtccacgtcctacacacgtcacgcacgtcctgctacgtcgtagtacgttnttacgtaacgtttaagtttctagtcgtacgagtacgtaagttactaacgttacgttaccgtacctttaacgttacctttacgtttccgggaacccggtacggtaaccgtacggtacggtacggtaactaccggtaaccgtaacggttacgtcggttaccggtagtaccgaccgtaacttccgg

SEQ ID NO: 69938 - DNA, 821 bp, Homo sapiens
  misc_feature: GYAE6OF02JP48L.51.76.G10.1.454.CMB.1.raw
  modified_base (116)..(116): a, c, t, g, unknown or other
  misc_feature (116)..(116): n is a, c, g, or t
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctnctactctgctcccagataccactggagaagtagtgatgacgcagtctccagccaccctgtctgtntcctccgagggaaancgccaccctctcctgcgagggccagtcaagagtcgttagcagcgacttacgcctggtaccagtacaacgaaacgtcggaccacggcctacccgaaggtccctaccgtacgacttaccgtattcggaacttcggacctaacgtacccgtaaacggaaacggggcccctaacgttacggtaaacgttaccccgtaccccgaggtacccggtaaacggtttccgtaaagggttcggacggttacggtttaacggggtccgttaaggggaaccctaacggttaaccggtttcccaccgtttacccggaaccctacccgtaacgtttacccggaaccgtaaccggacggtccccgttacgggaccgtaaacggttccgtaagttaacgtttacgttttacgacgtttaaacgttttaacttcgtacgtttaccgtaagacgtttaaacggttaacttaaacggttaaccgtaccggtttacccgtttaacgttaacccgtttcggttttacggaacccggtaccggggttaacctaacggtaacggttaaccggttacgaaaccgttaaaccgtaaacccggtaagtttacgggtaccggttacgtaacggtacccgacgtttaacccgg

SEQ ID NO: 69939 - DNA, 745 bp, Homo sapiens
  misc_feature: GYAE6OF02J0124.51.76.G10.1.454.CMB.1.raw
  modified_base (437)..(437): a, c, t, g, unknown or other
  misc_feature (437)..(437): n is a, c, g, or t
  modified_base (458)..(458): a, c, t, g, unknown or other
  misc_feature (458)..(458): n is a, c, g, or t
  modified_base (584)..(584): a, c, t, g, unknown or other
  misc_feature (584)..(584): n is a, c, g, or t
  modified_base (733)..(733): a, c, t, g, unknown or other
  misc_feature (733)..(733): n is a, c, g, or t
tcagcgatcgtatacacgaccggtgctcgatttagtcactcatacgagggggaggaactgctcagttaggacccagacggaccatggaagccccagcgcagccttctccttccctcctcgctactctggcctccagactaccacgtggagaagttaggtagagtcgacgcacgtcctaccgacgtaccctaccttcgtcttacgtcgtcctaccgggaaggggaaacgccgccccacccgttcgtcccgtacgacggacgggacctacgtcgaaggttagttacggttagacgacgtaccggtaacgttaccgtcggtacggtaaccagaaccgtaacggtaaccggtcggaccgacggtccctacggacgtcctcctacacttacgtcgtacgacttcaccacgtaccgaggtaaccgctaagctacctccgaccncgtacgaacggtcgtaacggngtacggttaggtccggtacgtcggaacgtgttacgtacctacgtcctactacctacgacgtcaccgtccggtacctgtacgagttccggtaagtacgtttattaacgttactttaatttaccgttntacggtccgaagttggtaaactaatttacgtaacggttccctaacgggttaccgtttacgtttacggttaccggacgggaccgtagtacgggttacgtaacgtacggtaaccgttaaggtaaccgtaggttaccgtagacccggttacnccgtacttaacg

SEQ ID NO: 69940 - DNA, 643 bp, Homo sapiens
  misc_feature: GYAE6OF02F2NE8.51.76.G10.1.454.CMB.1.raw
  modified_base (159)..(159): a, c, t, g, unknown or other
  misc_feature (159)..(159): n is a, c, g, or t
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgnagtctccagccaccctgtctgtgtctccgaggggaangccaccctctccngcacgggccagtcagtagtgttagcagcgtacttagcctggtaccagcaacgaaacctggaccagggcctacccgaggcctcctactacttctatcgtaatcgacctactacccgaacggtaacgggcctaatgtactacgtaccacgtaccgtaggttaccaggtcgacgtagggtggtacacgggaataacgtcttacacgttcctacaaccgtatcgtancagtccngacagtcngtaacgtgtttagactttaattacgttacgtattacgaacgttacgtaagttaactaacgtaaccgttcggtccctaagttacttacgttttaccgaccggtacgggtaaaccgacgttacgggacggttaacggtaaccgtaaaccggtaaacggtacgtacgggttaccggtacgtacggtacctacccgtacg

SEQ ID NO: 69941 - DNA, 727 bp, Homo sapiens
  misc_feature: GYAE6OF02HHVWL.51.76.G10.1.454.CMB.1.raw
  modified_base (200)..(200): a, c, t, g, unknown or other
  misc_feature (200)..(200): n is a, c, g, or t
  modified_base (360)..(360): a, c, t, g, unknown or other
  misc_feature (360)..(360): n is a, c, g, or t
  modified_base (446)..(446): a, c, t, g, unknown or other
  misc_feature (446)..(446): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccaccctgtcctgtcgtctcgaggggaaancgcccaccctctcctgcgaggccaggtcaggagtctagcagcgacttagcctaggtaccagacgaacgaaaccgtggaccgtacggcctacccgaggtcctaccctacactctatagtatcgccactaccgaacgaaccgggtccacgttgaacttaccnccgacgtacctacggttacagggtcggactagggttcgggtcgagggaacgtaggtacgtttaccgacccttctaccgaaccttanaccgaacgtccgaacgtcccgttaggctaacggtttcgaaacggtttaagtttagttttacggaactttaaactttttacgaacgtttccgtaacgtacgtaacggtttaaacttaaactaaccgttaaacgggtttcccggtaaccctttacccggtttaaaccgtttaccggtttccgggtaacccggaacgggggtccctaaacgggtcggtaacggtaacgtaaccgttaacgtaaacgtacggttggtacggtccgtacacccggttaacttacgg

SEQ ID NO: 69942 - DNA, 751 bp, Homo sapiens
  misc_feature: GYAE6OF02HW4YM.51.76.G10.1.454.CMB.1.raw
  modified_base (132)..(132): a, c, t, g, unknown or other
  misc_feature (132)..(132): n is a, c, g, or t
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccanataccactggagaagtagtgatgacgcagtctccagccaccctgtctgtgtctccgaggggaaancgccaccctctcctgcagggccagtcagagtgttagcagcgtacttagcctggtaccagcaacgaaaccctggaccacgggcctaccccgaggtccctacccgttcactttcctaagtggactggcctaactacccgaacggaacggggccctacgtcgaactactccccgacggacccgtaggttccgaaggtcggacgtacgggtcgggtcgtggggaactaggtacgtttaccacttcccgtacctacctaactaccgtacggacgacggtccctacggccgtacggttcgtaggtaaacgttacgttttacggtactttaaacgtttttaacttaccgtttacgttacgtaaggttccgtaaaggttaaacttaaacgtttaaacgttcccggttaacccgttttacccggtaaaccgttttaccgtttttaccggggacccggttaacgggggtaacccgtaacggtccggttacgggtaagtaaccgtaaaccgtaaaccggttaccggttagggtaccggtaccgtaacgtacccgtaccgttaccg

SEQ ID NO: 69943 - DNA, 656 bp, Homo sapiens
  misc_feature: GYAE6OF02H7EN5.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccacctctccgtgcagggccagtcagagtgttacgcagcgtacttagctggtaccagccaagaacctggaccaggcctccgaggcctctacatctatgatgctatccgaacggacggacctacgtgaactacgacccgagtacctaggtccaggtcggacgtacgggtgggtccgtagggacctagtacgtttccaacctccgtacccactactaccgacgtaccaacggtccctggactacggtccgtagtaacgtttagtttacggtaactttaaacttttacgtttacgtcgtaccggtaagttacgtaagttaactaaacggttaaccgtcggttacccttaccgttaaccgttacgtttaccgggaccgtacgggtacccgtaaggtcgtaacgggtataacgtaaccgtaaacggtacgtacggtaccggtcgtacgtacccgtataccgg

SEQ ID NO: 69944 - DNA, 744 bp, Homo sapiens
  misc_feature: GYAE6OF02GRVMF.51.76.G10.1.454.CMB.1.raw
  modified_base (474)..(474): a, c, t, g, unknown or other
  misc_feature (474)..(474): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaaggggaagagccacctctcctgcagggccagtacagacgtgttagctagcgtacttacgccgtgtaccaggccaacggaaacccgtggaccgacggccctacccgacggtcctcccttacacttacctagtcggactacgtccactacccgaacgaccgggcctaacgtgtaactaccgtaccccaggtccgtacggttacgtacggtcggacggttagggttcgggtaccgtaggggaacgtacggttaccggttactaccgtacctacccaacgtacacgtacncgtaccgtccgtacgcgtacgttccgtaagggtaaatttacgtttaccgtaaactttaacgttttaacgttaccgtttaggtaaccgacgttaaacgttaaggttaacgtttaaacttaccggttacccggttaccctttaacgtttaaacccgtttacgtttacgggacccggggtacgggttaactaccgggtacgtaacgggacgttaaccgtaaacggtaaccgttacggttacggccgttaaccgccggtacctacccggttacg

SEQ ID NO: 69945 - DNA, 843 bp, Homo sapiens
  misc_feature: GYAE6OF02IV334.51.76.G10.1.454.CMB.1.raw
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaacgccccagcgcacgcttctcttcctcctgctactctggcctccagactaccacgtggagagtagtgatgacgcagtctaccacgccacctgtctgtctcncgagggaanacgccacctctctgcgacggccagtcagtacgttgtacgcagcgtacttacgcctggtaaccagacaacgtaaccgtgaccgtacgcccgtacccgagtcccctacctctaacgttccgtatacgtcgtcaacgactacccgacgtaaccggcctaacgttacgacttaccgacccgtacggtacccgtaaggtttccgaggtcggtacgtaggggtacgggtcgtacgggaactacggttacttaccacggttccctaactaccgtagtaccgaacgtaccgtaccggtacttcgtacggtaaccgttgttaaaccgggttaaacttttacggtttaaccgttaacgttttaaacggttttaaccgtttacggtaacggtttaaaccacggggtttaaaaccgttaacgttttaaaaacggtttaaccgttaaccgggtttaaccccggttacccggttttaaccgtttaaacccggttttaacccgggttaccgggttaaaacccgggtccgggggttaaaaacccgttacgggtacccggggtttaaggaaaccggtttaacgtaaacccggtaaaccgggtttacggttaccggtttaaaccgggtcccgttacccgttaaaacgggttccccgtttaacgg

SEQ ID NO: 69946 - DNA, 834 bp, Homo sapiens
  misc_feature: GYAE6OF02I9ARN.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctgctcccagataccactggagaagtagtgatgacgcagtctccagccacctgtctgtgtctccgaggggaagacgccaccctcgtcctgcgacgggaccacgtacaggtagtgttagcgagcgtaacgttcgcctggtaccagacgaacgaaccttggccaacggcctcccgagcctcctacatactagtgtactgtccgtactccgaacggacggccctacttacgaacttaccgtacccgacgtaccgtacggtttacacgggttacggcgtacgggtttcgggtacggtacgggtactaacggggtttaccgtaccgtaacccggtttacctaccctaacccgttaacgtaaccccgtaaacggtccgtaaccggttccccgggtaaccgtaccggttaaccgttaccggtttaaacggtaaaaccgtttttaagtttttaacgtaaacccggttttttaaactttttaaacgttacgtttaacggtcccgttaaaagggtaccttaaaaggtttaaacttttaaacccggttaaccgttacccgggttacccgtttaacccgtttaacgttaaaccggttttaccccggaaaccggttacggggtaaccctaacgggttaacggtaccggtaaagttaaaccccgttaggtaaacccttaacggggttcgtaaccggttcctaccgggtaccctaaccggtttaccgg

SEQ ID NO: 69947 - DNA, 683 bp, Homo sapiens
  misc_feature: GYAE6OF02JZ1Y5.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctccagataccactggagaagtagtgatgacgcagtctccagccacctgtctgtcgtctccgaggggaaancgcctaccctctacctgcacgggccagtcaggtagtgttagcaggccgtacttagccttggtaccagtaccacgaaacccgtggaccacgggtcctcccgaggcctccgtacagttacctatcgtatcggcacgttccgaacgaacgggccctacgtagtaacttccgtaacccgaggtacccggtagttcgtacggtggaccgtagggtttacgggcgttacgggaacgtacggtacgttaccgtacgttcgtccctacgtatccgtaacgcgtacggtcctacgacgtgtacgtacggtaacgttcgtttacgtaacttaacgtttctaacgtcgtacgactagtaacgttaattaccgtaagtccgttaaccgttaccgttaacgttacggtttacggaccgttaccggctaacggtcggtacggtaactaacgttaccgaaagggttacttcgggagttaccggtccgtaacgttcgtaaccg

SEQ ID NO: 69948 - DNA, 756 bp, Homo sapiens
  misc_feature: GYAE6OF02HQ6KK.51.76.G10.1.454.CMB.1.raw
  modified_base (161)..(161): a, c, t, g, unknown or other
  misc_feature (161)..(161): n is a, c, g, or t
  modified_base (199)..(199): a, c, t, g, unknown or other
  misc_feature (199)..(199): n is a, c, g, or t
  modified_base (250)..(250): a, c, t, g, unknown or other
  misc_feature (250)..(250): n is a, c, g, or t
tcagcgatcgtatacacgaccggtgctcgatttagtcactcatacagggggaggaactgctcagttaggacccagacggaaccatggaagccccagcgcagcttctcttcctcctgcctactctggctcccagataccactggagaagtagtgatgacgcngtctccagccaccctgtcctgtgtctccgaggggaaangccacctctcctgcacggccagtcagtacgttgttacgcagcgtacgttanccgtaggtaccagacaacgtaaccgtggaccgacggtcctcccgaggtcctacccgtcattcctaatggtatcggactacgtccgaaccggaacgggtcctaacgtacggtaacttaaccgtcccgaacggtacccgttaagggttccgtaacggggttcggaccgttaaggggtttccggggtccgtaagggggtaacgtaacggttaaccggtttcccgtaaccgttccgtaacccctaccgtacctaccgacggtacctacggtccctggtacctacgggttaacccgtaagttaacgttaacgtttttacggtactttaaacgtttttaccgttagttcgtacctaagtacttaaagttaaacgttacgtaacggtacgttaccccgttaccggtttaacctaccggttttaccgggaaccggtaccggggtaaccgtaacggtcggtttaaggacgtaacgtaacgaagttacgtggtaccggtcgtaccgcgtacctccg

SEQ ID NO: 69949 - DNA, 712 bp, Homo sapiens
  misc_feature: GYAE6OF02FQI3Z.51.76.G10.1.454.CMB.1.raw
  modified_base (196)..(196): a, c, t, g, unknown or other
  misc_feature (196)..(196): n is a, c, g, or t
  modified_base (335)..(335): a, c, t, g, unknown or other
  misc_feature (335)..(335): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgtagcagcgacttagcctggtaccagcagaacctgaccaggctcccaggtctcctcatctatgatgcactccacgaacggccagtgtatactccagtccgtaggttacgnggtcggacgtagggttcgggtcgttagggactaggtaacgtttccaccttccgtaccctaaccacgttaccgacgccgtaacggcccgttacggacctaggttaccgtaggtaaacgttacgtttttacggtaactttaaacgtttttaaccgttaaccgtttacgttaaccgtacgtaaccgtaaagtttaaacgtttaaacgttaaaccggtttaccggtaccccgtttaacccgttaaccgtttaccgggtttttaccgggaacccgggttaaccggggtaacccgaacgggtacgttacgggaaacgttaaccgttaaccgtaaaccggttacgttacgggttaccggtcgtacgtacccgtaacgttacccg

SEQ ID NO: 69950 - DNA, 652 bp, Homo sapiens
  misc_feature: GYAE6OF02G7CQP.51.76.G10.1.454.CMB.1.raw
  modified_base (280)..(280): a, c, t, g, unknown or other
  misc_feature (280)..(280): n is a, c, g, or t
  modified_base (314)..(314): a, c, t, g, unknown or other
  misc_feature (314)..(314): n is a, c, g, or t
  modified_base (608)..(608): a, c, t, g, unknown or other
  misc_feature (608)..(608): n is a, c, g, or t
  modified_base (617)..(617): a, c, t, g, unknown or other
  misc_feature (617)..(617): n is a, c, g, or t
tcagcgatcgtatacacgaccggtgctcgatttagtcactcatacaggggaggaacgtgctcagttaggacccagacggaaccatggaagccccagcgcagcttctcttcctcctgctactctcgctcccagactaccactgagaagtagtgatagacgcagtctcagccacctgtctgtcgtctccgaggggaaagacgcccacctcctcctgcgacggccagtcagagttgttaagcacgcgtacgttacgccgtggtaccaggtacacgtaaaccgnggccaggcctccgacgtctacctcgtactctacngtatcgactactccaacgaacggcctactcgactaaccttcccacggacctacggttacgaacggttcgggccttaggggacgggtttaccggaggggtacctacgggtaacgttttccgaacttccgtaccgtaaccgtacgtacgtacgtaccgaccacgtaccgtcgtacggttacctacggttacgttattacgtacgtaacgtttacttacgttagtacgactacgtaactaagtaacttaacgtcgtaccttacgttacttacgttacgaccgtacggacgtaaccgngtacggtanactaagtaacggacttcggtagctcgagaacctcg

SEQ ID NO: 69951 - DNA, 783 bp, Homo sapiens
  misc_feature: GYAE6OF02GYLSR.51.76.G10.1.454.CMB.1.raw
  modified_base (115)..(115): a, c, t, g, unknown or other
  misc_feature (115)..(115): n is a, c, g, or t
  modified_base (476)..(476): a, c, t, g, unknown or other
  misc_feature (476)..(476): n is a, c, g, or t
  modified_base (715)..(715): a, c, t, g, unknown or other
  misc_feature (715)..(715): n is a, c, g, or t
tcagcgatcgtatacacgaccggtgctcgatttagtcactcatacaggggaggaactgctcagttaggacccagacggaaccatggaacgcccagcgcagcttctcttcctcctnctactctggctcccagactaccactgggaagaagtagtgatggacgcagtcctccacgcccaccctgtctgtcgtccgtaccgaaggggaaacgacgtccctaaccccttcttccgcggaccgaccggggacctacggttacgaagggtacggttaggttaacggccgtaacggcggttaaccttacggcccgttaacgggtaacccacggaaccgtaaacggtaaaaccccggtcgggacccgaacggtcccctacccgaacggtcccttcccctataccgtcgttagtacgtacggtacacctacctaaccggaacggtaccctctacgtagtactcccgaccgactccgtaggtacgnggtcggtcgtaggggttacgggtccggtaggactttacgggtaacttccttaacccgtccgttaaaccctagttacgaccgttacggccgttaaccgggcctaggttacctacgggttacgttaaacgttaagttttccggtttaacttacgttttaaacttacgttacgtacgttaagtaaccttaagtacctttaagtacgttaccgtccggttaccttaacgttctacgggtaccncggtaccgagtacggtagacggaactacgtaaacgcggtaacggtcgtacgccgtaactcgtactacg

SEQ ID NO: 69952 - DNA, 613 bp, Homo sapiens
  misc_feature: GYAE6OF02FWYTA.51.76.G10.1.454.CMB.1.raw
  modified_base (196)..(196): a, c, t, g, unknown or other
  misc_feature (196)..(196): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaangccaccctctcctgccagggccagtcagagtgtagcagcgacttagcctggtaccagcagaacctggccaggctcccaggctcctcatcatgatgcatccaacgaggccagtgatactccagccgtagttcagttggcaggtggtcgtagggaacaggtattccaacgttctacacctatacgagcaacgtcccgtgacctagttcgtagtaaacgttagttttacgaacttaattttacgttaacgtcgttaaccgagtaacgtaagttaactaaactaacggtcggttaacccttaccgttaacttaccgtttacgggacccggtacggggtaacccaagggttccgtacgggtaactaaccggttaaccgaaaggtaccgttagggtaccggtacctacggaccctacttaccg

SEQ ID NO: 69953 - DNA, 894 bp, Homo sapiens
  misc_feature: GYAE6OF02I9RY0.51.76.G10.1.454.CMB.1.raw
  modified_base (233)..(233): a, c, t, g, unknown or other
  misc_feature (233)..(233): n is a, c, g, or t
tcagcgatcgtatacacgaccggtgctcgatttagtcactcatacagggggaggaactgctcagttaggacccagacggaaccatggaagcccccagcgcagcttctcttcctcctgctactctggctcccagataccactggagaagtagtgatgacgcagtctcagccaccctgtctgtgtctcgagggaagagccaccctctcctgcacgggccagtcaaggagtgttancagcacgttagcctggtaccagcaacgaaaccgtcggaccacggcctacccgaggcctacctactaattaccgtaagttgacgttgccgaacttacccgaacgtaacgggaccctaacgtagaactaaccgttaccccgacggacccgtacggtttaccaagggtttacgggaccgttaacggggttagggggttacccgtttaacggggggaaaccttaacggggtaacggttttaccccggtaaccgttacccgtttaacccgttaaacccgttaaccttacccggaaacgggtacccgtaaccgggtaccccgtttaccgggtaccgtaacgggtttaaccgtttaacggggtaaacggtttaacggttttttaacgttaaacgtttaaaacgtttttttaacggttttaacccgttaaccggttttaccgaaaccggttaaccgttaaaacggttttaagttaaaaacgtttaaccctttacccggggttaacccgtttacccgtttaaaccgttaccggttttttacgggaaccccggttaacgggggtaacccgttaacgggtaacccggttaagggaaccgttaacggttaaccgtaaaacgggtaccgtttaaggttaccggttactaccgggtacccctaaccgttaaccgg

SEQ ID NO: 69954 - DNA, 865 bp, Homo sapiens
  misc_feature: GYAE6OF02F074G.51.76.G10.1.454.CMB.1.raw
  modified_base (158)..(158): a, c, t, g, unknown or other
  misc_feature (158)..(158): n is a, c, g, or t
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacncagtctccagccacctgtctgtctctcgaaggggaancgccctaccctctcctgccgagggccagtcagtagtgtagcagacgtacttacgccgtaggtaccagaccgaacgtaaaccgtggacccacggtcctacccggaggtcccttacccgtactaacgttcctaacgtacggtactcggtacccaacgttaccccggaaacgaccggggtaccctaacggttaactaaccgttacccgtaacccggtaaccgtaccccggttaagggtttacggacggttaccggggtccgtaacgggggttttcgggtaccggttaacgggggaacttaaccggggttaaccggtttacccttaaccccggttacctttaaacccgaaccgttaacgttacccgaacggtacccggtaccgttccccgggagttaacccgttaacgggttccgttaaaggttaacggttttaaccttttacggaaactttttaacgtttttaacgttaccgtttaacgggtacaacggtttaactaaacggtttaaaccgttaaaccgttaaccgttaccgttacccgttaaccgtttaaccgtttacgggttaacccgaaccgggtacggtaacccgaggtttaccggaaggttaacgtaacggtaaccgttaaaggtaccgttcggttaacggtaccgtaaccggtacctccgtaaccgg

SEQ ID NO: 69955 - DNA, 758 bp, Homo sapiens
  misc_feature: GYAE6OF02FI2DQ.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctcagccaccctgtctgtcgtctccggaaggggaagcgcctaccctctcctgcgacggccagtcgagtagtgttagcagcgtacttacgcgtggtaccagacaacgaacctcggactacggcctcccgacggcctccctactactctatacgtagtcgacctaccgtaccgaaccggaacgggtccctaacgttacgtaactacccgtaaccgacggtaccgtacggttacgtacgggttccggacggttaggggtttacgggtcggtacggggaacgtaacggttaccgttacccgtaacttaccgttaccgaacctaacgtccgaaccgtacgaccggtaccgtcgacgttacggttaccgaaggttaacgtttacgtttaacgttacttttaaacgtttaactttaacgttggttaaaccacgttaacggaaacttttaactaaaccgttaccggtccgttaacccgtttccttaacggtttacgtttacggggaacccggttacggaaccgttaggttaacggacgggttaacctaaccggtaaacccggtaacgtacgttaccgggtccgtacggacctacttaccgttcg

SEQ ID NO: 69956 - DNA, 811 bp, Homo sapiens
  misc_feature: GYAE6OF02GFXT6.51.76.G10.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcgagtgtgtacgcagcgtatacgccgtacgtaaccgtagacgaaacgaaccgtcgaccggtagtccctacccgaggtccctcccgtataacttcgttaagtcgtaagtcgactactacccaaggaacccggctacgtagtacttaaccctcccgacggaccgtacgggtttaccgaggggttcggaccgttaagggggttccggttaccgggtacggggtaaacgtaacgggtttaacgttacccgtaacccttttaccggaccccttaacccgttaacgttaccggaacgtaccggtaacccggtcccttcgggaaccggttacgttaccggttaacggtaaaggttttaccgttttacggaaacctttttaaacgttttaacgtttaaccgttccttaacggtacctaaccgttaaaggttaaactttaaaccgtaacggttacccggttaacccctttaaccggtaacccgtttttaacggtttcccgggtaacccgggtacggggtaaacccacgggttcggtaaaccgggaatacgtttaaaccgaaaccgttaaggtcggttacggtacgtccgacctacgtccg

SEQ ID NO: 69957 - DNA, 829 bp, Homo sapiens
  misc_feature: GYAE6OF02G95XO.51.76.G10.1.454.CMB.1.raw
tcagcgatcgtatacacgaccggtgctcgatttagtcactcatacagggggaggaactgctcagttaggacccagacggaaccatggaagccccagctcagcttctcttcctcctgctactctggctcccagatgccaccggacaaattgtgttgacacagtctccagtcaccctgtctttgtctccgaggggaaagcgcctaccctctcctgcagggccaggtcagacgttataacgagcgacttacgccgtggtaccagacaacgaaacctgggccagggcctcccgaggtacctcctacagttcctagtcggtcgcaactcccacgtcgaacgggccctacggtggacctacgtcccgacggacccgtagggtttaccaggtcggtaccgtaggggttacgggttccgaggggggaacctaaacgggttccgtttccggccgttcctaacctaacccgtaattaccgacgacgtaccgtaccgttacggacgcccgttaaggtaaccgttagtttacgtaccgttattttaagtttacgtttacgtacgtacgtacgtaaccggtaaaccgtaaaaccgtaaccggtttcccggtaccccttttaccgggttaaccggggttaccgggtttaaccccgggtaacccgggaaaaccgggttaccgggtaaaccgggttaacgggtttaaaaccgaacccgggttaaaaaccggtaaaccggtttaccggttacggggaccccgtttaacgggaccccgttaaccggtaaccggttttcccgtaaggtttttacccccgtttaggtttaacccccgtttacccccggg

SEQ ID NO: 69958 - DNA, 662 bp, Homo sapiens
  misc_feature: GYAE6OF02IWIN8.51.76.G10.1.454.CMB.1.raw
  modified_base (203)..(203): a, c, t, g, unknown or other
  misc_feature (203)..(203): n is a, c, g, or t
tcagcgatcgtatacacgaccggtgctcgatttagtcactcatacagggggaggaactgctcagttaggacccagacggaaccatgggaagccccagcgcagcttctcttcctcctgcctactctggcctcccagataccactggagaagtagtgatgacgcagtctccagccaccctgtctgtagtctaccgaggggaaacngcccaccctctcctgcagggccagtcagacgtgttagcagcgacttagcctaggtaccagacagaacctggaccaggcctcccgagcctcctcatctagtgactcgcacgtccaacggacggtccatgatactacccgagaccgtaggtacaggtacggcgtggtggtacgtggaacagtacgttcaagtccctaacacctattacccgaagccgtaacgtacccgtgtaaccgtagttaccgtaacggtaatttacgttttaacggaaccttttaaagtttacgttaactttccgggtaactaaggtaccctaaaggttaactaaacggttaaccgtcgtaacccgtttaccgtaccgtttaaggttaccgacgtacggggaaccttaagggcgttaacggaataaccggaaacgtaaaccgtaaggttcggtacggtactacggttaccacgttaac

SEQ ID NO: 69959 - DNA, 694 bp, Homo sapiens
  misc_feature: GYAE6OF02GGLTB.51.76.G10.1.454.CMB.1.raw
  modified_base (198)..(198): a, c, t, g, unknown or other
  misc_feature (198)..(198): n is a, c, g, or t
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (320)..(320): a, c, t, g, unknown or other
  misc_feature (320)..(320): n is a, c, g, or t
  modified_base (449)..(449): a, c, t, g, unknown or other
  misc_feature (449)..(449): n is a, c, g, or t
  modified_base (516)..(516): a, c, t, g, unknown or other
  misc_feature (516)..(516): n is a, c, g, or t
tcagcgatcgtatacacgaccggtgctcgatttagtcactcatacagggggaggaactgctcagttaggacccagacggaaccatggaagccccagcgcagcttctcttcctctgcctactctggcctcccagataccacgtggagaagtagtgatgacgcagtctcagcctacctgtctgtcgtctccgaagggaanagcccaccctctcngcgaggccagtcagngtagtagcagactacgttagccgtagtaccagaccaagaacccgtcggaccgaggtccctccgacgcctcccgtcacgttctagctatcgacncgtaccgaacgacgggaccctagtcgtaactccgtacccgacgtaccgtacgttacggaacggtcgggaccgtagggttcgggtacgttagggaacgtgtacttaccgtcgtcctacctacgactacgngtaccacggtccagtccgaacgttagtacgtagtttcgttagtaacctttagttttaccgtacgttntacgtacgtataacggtttataaaccggttcgtaaccgttcccgtttaaccgttacgttacgggtttccggaagggtacccgggaaccgtagggttaaccggtaacggaccgtaacgttaaaccggtaaacccgtacgggttctaaccggttcggaacgttacccggtaactaaccgg

SEQ ID NO: 69960 - DNA, 954 bp, Homo sapiens
  misc_feature: GYAE6OF02FLING.51.76.G10.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
tcagcgatcgtatacacgaccggtgctcgatttagtcactcatacagggggaggaactgctcagttaggacccagacggaaccatggaagccccagcgcagcttctcttcctcctgctactcgtggcctcccagactaccacgtggagtaagtagtgatgacgctagtcctccacgcccaccctgtctgtntcgtccgagggaancgccaccctctcctgccgacgggtccagtcaggtagttgttagcgagtccgtacgttacgccgttacggtaccccaggaccaacggtaaacccgtgggaccccgacgggtcccctaccccggtaacggtccccttcccgtactacgtcctagttacgacgttcgaccgacctaacccgaacggtaaccgggtccctaacgtaggtaaaccttaccccgtaccccgaggtacccggttaacggttaccgtagggtacgggtaccggttacgggttcgggggttcctagggggtaccgtaacggtaccggtttaccctcgtttacccgtaacctacccgttaagtacccgacggtaccttacccgggtaaccggttcaaccgggttaacggtttacccgttaaagggttaaccgtttttaacggttttttaccggtaaaacccgtttttttaaaacgtttttaacccggtttaaccgttttacggtttaacccgggtaacgtttaaaccgtttaaacgggttttaaaacctttaaacccgggttaacccggttttaccccggtttaacccgtttaacccgttttaaaccccggttttagggtttaccccgggtaaacccggggttaccggggtaacccgtaacccggttaacgggggttacggtaaaccgggttaaccttaaccccggttaaaacggttaccggtttcgggggtaaccctacggtaacccggttaaccgtacgtttacccg

SEQ ID NO: 69961 - DNA, 811 bp, Homo sapiens
  misc_feature: GYAE6OF02HUAYU.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggggaggaactgctcagttaggacccagacggaaccatgggaagccccagcgcagcttctcttcctcctgctactctggctcccagataccactggagaagtagtgatgacgcagtctccagccaccctgtctgtgtctcgaggggaancgccaccctctcctgcacgggcctagtcagtagtcgttagactagcgtacttagccgtaggtaccaggcaacgtaaaccgtcggaccagggtccctaccccggaggtcccttaccgtacctaacttaccgtaagtcggtagtcggacctactacccgaacggaacggggtcccctaacgtacgtactaccgtcccgaacggtccgtaggtttcgtaacggtcggacggttacgggtcgggttacggtacggggaacgtagggtacgtttaccgaccgtttaccgtaacccgtaaccgtaacgtaccgaacggtaccgtacggtcccgtagtaccggtaacgttaccgttaagggttaaacgtttacgttttacggtaactttaaacgtttttaacgttaacgttcggttaaccgtacgtaaccgttaaacggtttaacgttaaaccgttaaccggttaccgtacccgtttaacccgttaaccgtttaaccggttttaccgggaacccggtacggggtaacccgtaacgggtccgttaaggggaactaaccggttaaaccggtaacgttaacggtacgggttacggtaccgtaacggtaccctaccgttaaccgg

SEQ ID NO: 69962 - DNA, 843 bp, Homo sapiens
  misc_feature: GYAE6OF02HVV25.51.76.G10.1.454.CMB.1.raw
  modified_base (143)..(143): a, c, t, g, unknown or other
  misc_feature (143)..(143): n is a, c, g, or t
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (375)..(375): a, c, t, g, unknown or other
  misc_feature (375)..(375): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactgganaagtagtgatgacgcagtcctccagccaccctgtctgtntctccgaggggaaangaccacctntcctgcgaggccagtcagtagtgtaacncgagcgacttagccttaggaccagcgaagtaaccgtcggccaggtcctcccgaggccttacctcaacttcgtatgtactcgactactaccacgaacgggccacgtacggactacgaccacggtaccctaggtccaggtcgngtaggtcgggtacggtcgggaactacgggttacttaccgtaccttccgtaacccgtactaacgtcgtaacgaccggtaacgtacccgtttaggacccgtttaacggtcgttaaacgggtaaccgttttaaggtttcgttaaacgttttaaacggtttttaactttaacccggtttagttaccggttaacgtaccgttaaacgttaaacgttttaaaacccgtaacgggttacccggtttaaccccggttttaaccgttttaaaacccggttttaacccgggtttttaacccggggaacccgggggttaaacccggggggttaaccgtaaacccgggttaacccggggttaaggggttaaaaccgtaaccgggtttaaaaccccgggaaaacccgggtttaaacgggttaccggggttaccggtttacccgggttaaaaccccgttaccggtaacccgtttaacccggg

SEQ ID NO: 69963 - DNA, 600 bp, Homo sapiens
  misc_feature: GYAE6OF02F8Y7H.51.76.G10.1.454.CMB.1.raw
  modified_base (196)..(196): a, c, t, g, unknown or other
  misc_feature (196)..(196): n is a, c, g, or t
  modified_base (430)..(430): a, c, t, g, unknown or other
  misc_feature (430)..(430): n is a, c, g, or t
  modified_base (458)..(458): a, c, t, g, unknown or other
  misc_feature (458)..(458): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttagcagcgtacttagcctggtaccagcagaacctggccaggctccgaggctcctcatctatgatgcatccaagaacgggccactgatactcccagccaggttcaggtgcctaggtgggtctggggtaacaggtacgttcctaccgtcctaccgaacctagtaccaggtacctacggtccctagccgtagtcctgtaaagtnttttacgactttaattttacttacgttntacgacgtataagttaactaaacgttacgttcggtccctttaccgtaaccgttacgttttacgggaccgtacggggaccgtaacggcgttaaggacttaacgaacgtaaacgtacgtggtacgacgtacgaccgtactaccg

SEQ ID NO: 69964 - DNA, 784 bp, Homo sapiens
  misc_feature: GYAE6OF02GPHR1.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgagggaanagccacctctcctgcagggccagtcagtagtgttagcagccgtacgttacgcctggtaccagtcaacggaaacctggacctaggcctacccgaggtccttcctctaagtcctaatcgactcgacctactccccgaacggaaccggcccaacgttacggaacttaccgtaccccgagtacccgtaacggtttccgaaggtcggacgttacgggtcgggttacgtacggggtaactaggttacgttcctaaccgttccgtacctaaccgtacgtaccgtacggaccgtacgtcccgttacggcgttaacgttaccggttaagggttaacgtttaaggttttaccgtaaccgttttaaacgttttacgttaaccttacggttaccgtaaggttaacgtaaaccggtttaagttaaaacccgttaccggttaccggtacccgtttaaacccggtttaccttaaccggttttaccggggaaccggttacggggtaacccgttaagggtccggtaacggtaaccggttacttaaacccgtaacggtaccgttagggttaacccggtacgttaacccggaccgttacgttacccgg

SEQ ID NO: 69965 - DNA, 814 bp, Homo sapiens
  misc_feature: GYAE6OF02HCUUP.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagactaccactggagaagtagtgatgacgcagtctccacgccaccctgtctgtgtctcgaggggaaancgcccaccctctcctgcacgggccagtcagagtgttacgcagcgaacgttgccgtaggtaccagcaacgaacctcggaccgacggtcccctcccgacggtcccttccctactacttctacgtggtactcgacctaaccgtacccaaacggtaaccgggccctaacgtacgtaacctaccctacccgacggtcccgtaaggttacgtacgggtagggccgtacgggggtttgggtacggttacggggaactacggtacgtttacctaaccctcctaccaacccgtactcggaacgaccggtacgtcccggttagtacgtacgttaccgttaagggtaaaccttttagtttacgtaactttttaaaccgtttacgtttaccgttcggttaaccgtaacgttaacgttaaacgttttaaaacgttaaaccgtttaccggttaccccggtttaaccctttaaacccggtttccgggtttaaccgttttacccggggaacccgggtacgggggaaaccttaccgggttaacccggagggtaaaccctaaaccggttaaccggaaaccgtttacgggttaccgggtacggttaccccggtacgtaacccgttaccggttaacg

SEQ ID NO: 69966 - DNA, 805 bp, Homo sapiens
  misc_feature: GYAE6OF02FSQGF.51.76.G10.1.454.CMB.1.raw
tcagcgatcgtatacacgaccggtgctcgatttagtcactcatacagggggaggaactgctcagttaggacccagacggaaccatgggaagccccagcgcagcttctcttcctcctgctactcgtggcctcccagactaccactggagaagtagtgagtgacgcagtctccgagccaccctgtctgtgtctccgaggggaaagcgccaccctcgtcctcggcacgggccagtcgagacgtgtagcagcgacgttagccgtaggtaccagaccaacgaaaccgtcggaccgaggtcctccccgaggtacctccccgtactacgtcgttaatcgaagttcgacctaacctacccgaaacggaacgggtcccaacgttcgaaactttacccgacccgacgtaccgtaacggttcaacgggtcgtacgtacgggttgggtacgtacggggaactacgtacgttcctaccgttccgacgtaacccgtacgtaccgaacgtccgaacgtccgtgtaaccggtacgttacgttaacgttaaacggtttacgttttacggaaaccttttaagttttaaccttacgtaccgttactaacggttaacgtaacgtttaaacttaaaccgtttaaccgtccggttaacccgtttaaccggttaaaccggttttacgtttaaccggggacccgggttaacggggaacccttaagggtacccggttaaagggtaacccgtaaacggttaaaccccggaaaaccggtttacggttacggttaacccggtaccggttacgtaaccccggttaacgtaccgg

SEQ ID NO: 69967 - DNA, 671 bp, Homo sapiens
  misc_feature: GYAE6OF02GKGQV.51.76.G10.1.454.CMB.1.raw
  modified_base (145)..(145): a, c, t, g, unknown or other
  misc_feature (145)..(145): n is a, c, g, or t
  modified_base (194)..(194): a, c, t, g, unknown or other
  misc_feature (194)..(194): n is a, c, g, or t
tcagcgatcgtatacacgaccggtgctcgatttagtcactcatacagggggaggaactgctcagttaggacccagacggaaccatgggaagccccagcgcagcttctcttcctcctgctactctggctcccagataccactgganaagtagtgatgacgcagtctccagccacctgtctgtgtctcgagggaancgccaccctctcctgcgacgggccagtcagtagtgttagcagcgtacttagcctggtaccagcaagaaccgtggacctaggcctacccgaggcctcctacacttctagtgactgctaactccgaacgacgggcccagtacgactaccaccgagccgtagtacgacggtacgcgtagggttcggtacgtagggaactaggtacgttccacgtccgtacgacctacgtacgacgccaacggtcccgtagacctagttacgtaagtaacggtttacgtttcgaaacttttatttaaccgttacgtcgttaacggacgttaacgttaacggttaaacttaacgttaccgtaccggttacccttaacccggttactttaaccgggttacggaccggtacgggtaaccgtacggtcgtaacggtaacgtaccttaaccggaacgttacgtcggtacgtaccgtacgtacccgtacgtttaccg

SEQ ID NO: 69968 - DNA, 796 bp, Homo sapiens
  misc_feature: GYAE6OF02HWWN4.51.76.G10.1.454.CMB.1.raw
  modified_base (146)..(146): a, c, t, g, unknown or other
  misc_feature (146)..(146): n is a, c, g, or t
  modified_base (167)..(167): a, c, t, g, unknown or other
  misc_feature (167)..(167): n is a, c, g, or t
  modified_base (356)..(356): a, c, t, g, unknown or other
  misc_feature (356)..(356): n is a, c, g, or t
tcagcgatcgtatacacgaccggtgctcgatttagtcactcatacagggggagggaactgctcagttaggacccagacggaaccatggaagccccagcgcacgcttctcttcctctggctactctggctcccagataccactgganaagtcgtgatgacgcagtccncagtccaccctgtctagtgtccaccgaggggaaaactcgtcccacccgttcgtacctggccaacggggcctaagtccgaagtcggttacggttaacgctaagccggtaactttagcccgtgggtaccagtccaagtaaccgtggccaggcctacccgaggccttacctcgactactagtagatcgtacncttaccaacgacgggcctacgtacgactacgttaccccgaggtacccgaacggtttccgtaaggtcgggtaccgagggtttcgggtaaccgttgggggaactacggttaccgttaacgtaccgtcctttacgaccctaagttccgaacgtcctacgtacccgtgtaccgtacgttccgtaacggtaacgttagtttaccgtacggtttaaacttttaacgttaacgttacgtaccgtacgggtttaccgtaaacggtttactaaaccgttaacgtacccgggttaacctttacccgtaccgtttaacccgtttacgggtaacccgggtacggggttaacccgtaccgggtaccggttacgggtaacggtaaccgttaacccgtaaaccggttacggtaccgggttacggtaccggttacccgtccggtaaccctacccgg

SEQ ID NO: 69969 - DNA, 878 bp, Homo sapiens
  misc_feature: GYAE6OF02G1ODV.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccacgtggagagtagtgatgacgcagtctcagccaccctgtctgtcgtcctccggaagggaancgcccaccctctccgtgcgacgggcctagtcgagtacgtagttacgacacggtacgtaaccgttacgacccggtacgggtaaacccagaacccgtaaacggtaaaaccccgtcggggaaccccacggggtacccctaccccgacgggtcccttcccctaacgtacttaccgtaagttacggacttacggaccttaaccgtaaccccggaaaccggtaaccgggtacccctacgttacgtaaacgttaaccccgttaccccgaacgggtacccgttaagggtttacccggaaggggttcggtacccggtaaggggttttccggggttaccggtacgggggtaaacgtacgggtttaaccgtttacccggaccctttcctaaaccccgaaccgttacctacgggaaacctccgggtaaccgtacccgttacgggaactaaccggtttacggaaagggtttaacttttacgtttaaccggtaaacttttaacgtttttaacgtaccgttacgtacgtaagttacgtaaagtttaactaacgttaaccgtcccgttacctttaaccggttcttaacgggtttaccggaccggtacgggtaacctaaggtccggttaacgggaacgtaacccgtaaagtaaccgttacgggttacgggtacccgttagacgacccctaggttacg

SEQ ID NO: 69970 - DNA, 905 bp, Homo sapiens
  misc_feature: GYAE6OF02HW11B.51.76.G10.1.454.CMB.1.raw
  modified_base (211)..(211): a, c, t, g, unknown or other
  misc_feature (211)..(211): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgggagaaagttagtcgagtacgaccgcaaggtctccgagcccacctgtcctgtcgtctccgaaggggaaancgcccacctcgtcctgccgacggccgtagtccgaggtacggttagttagaccgaggtaccgtaccgtttaacggccccgttaggggtaaccctaaggaccaaaccggtaaaaccccgttgggtaccccgaacggggacccccttacccccggacgggtcccgttaccccgttaccacttttaccgtagttacggacgtcggactaccctacccggaaccgtaaaccggggtcctaacgtcgtaaactaccgtccccgacggtaccgttacggttgaggtcggagtcggtacgggttcggtaacgggcgaagttcccgttaccaccgttacccgtaccaacgtactaccgtaacggtccgtaccgggccgttcgaaccggttacgttacgtacggtttaaacgtttacgtttacggtttaactttaacgttttaaacgtttaccgttacgggttaccgtaagttaaacccgttaagttaaaccgttaaacggtttaaccggttacccgttaccccggttttaacccggtttaaccggtttacccggtttttaaccggggtccccggtaaaacccgggggtcggttaaccggttcgggaaccggggtttaaccggaaaccgttaaacccgttaaccgggtaacggttcggggtaaccggttaaccggtacccggtaccccgttaccgttaacccgg

SEQ ID NO: 69971 - DNA, 701 bp, Homo sapiens
  misc_feature: GYAE6OF02G064K.51.76.G10.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagngtgttagcaggcgtacttagccgtggtaccagcagaaacctggaccaggcctcccgaggctcccgtcatctaatgatcgcactccacaacgggccactgatacncccacncctaggtcaggtcggcgaggttgggtcgtgggactaggtcgttccgaccttcgtacccacgtatacccgagtccgacggtccctgccgtacgttacgtaggtaacgttagtttttcgaacctttaaagtttttaccttaaccgttggttaccgtacggtaacgttaacgttaacgtttaacgttaaccggttaccggtacccctttacccggttaacccgttttaccggttttaccgggacccgggttaacggggtaacccgtaacgggttaccgtaacggggttaacgtaaccggttaaaccgtaaaccggttaaccggttcgggttaccggaccgtttaccggtaccgtaacccgtttaaccg

SEQ ID NO: 69972 - DNA, 749 bp, Homo sapiens
  misc_feature: GYAE6OF02J2JED.51.76.G10.1.454.CMB.1.raw
  modified_base (200)..(200): a, c, t, g, unknown or other
  misc_feature (200)..(200): n is a, c, g, or t
  modified_base (429)..(429): a, c, t, g, unknown or other
  misc_feature (429)..(429): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccacgtggagaagtgtgatgacgcagtctccagccaccctgtctgtcgtctccgaaggggaaancgccctaccctctccgtgccagggcccagtcgagtaggtgttagccgagtcggactttcggccgtcggtaccaggtacaacggaaacccgtggacccagggccttaccccgaaggtcctttaccccactattaccctaagttcggaacttcgacaccttacccgacggaacgggttcccaggttacacgttacccaccgacgtccgtaaacggttcgaacggttccggntagggttcggttccggaggaccgtaagttccgtacttaacccgtctacctaccacgtttaccgacggaccgtcgtaccccggtagtcccgtaaacggttcctaaggtagtttacgttaacggttattaaaaccgttttcgtaacgtttcgtaccgttaagacgttaacggtaattaaccggttacgtccgttaaccgttccgtaaccggttacgtttaccgacggtaaccggtataaccgggttctaacgggtataaccgtttaacccggaaaggttccgtagggtttaccggaccgttaacgtacccggttaattcccg

SEQ ID NO: 69973 - DNA, 668 bp, Homo sapiens
  misc_feature: GYAE6OF02IV4V6.51.76.G10.1.454.CMB.1.raw
  modified_base (206)..(206): a, c, t, g, unknown or other
  misc_feature (206)..(206): n is a, c, g, or t
  modified_base (319)..(319): a, c, t, g, unknown or other
  misc_feature (319)..(319): n is a, c, g, or t
tcagcgatcgtatacacgaccggtgctcgatttagtcactcatacagggggaggaactgctcagttaggacccagacggaaccatggaagccccagcgcagcttctcttcctcctgctactcgtggctcccagactaccactggaagaagtagtgatgacgcagtctccagccctaccctgtctgtgtacctccggaaggggaaancgcccaccctctcctgcgagggccagtcgagagttgttacgcgagcgtacgttacgcctgggtaccagtacaacgaaccgtggaccgtaggccttacccgaggtccttaccgntacttcgtaatcgagtcgaccactaccgagaaccgggtcctaagtgaactaccgtaccgaacgtccgtaggttaccaagggtccgtacgtacgggttgggtacggtacgggaactaacgggtacttcgaacgttccaccgacctatacgacggactacgacctcggatacgttaggtagtaaagtttacgtttacgaaacttttaagtttaactcgtagtaactgtaaccgttaagtacttaaagtcgtacgtacccttacttaaccgttgggttaaccgcggtacgactacggtcgtacggaattcgaacccgtagtaccgtagtccggaccttaggacctacttacg

SEQ ID NO: 69974 - DNA, 568 bp, Homo sapiens
  misc_feature: GYAE6OF02HLDKW.51.76.G10.1.454.CMB.1.raw
tcagcgatcgtatacacgaccggtgctcgatttagtcactcatacaggggggaggaactgctcagttaggacccagacggaaccatggaagccccagcgcagcttctcttcctcctgctactctggctcccagataccactggagaagtagtgatgacgcagtctcagccaccctgtctgtgtctccgaggggaaagagccaccctctcctgcagggccagtcagagtgttagcagcgacttagcctggtaccagcagaaacctggccaggcctcccaggctcctcatctatgatcgcatccacgaacgggccatgatactccagccagttcagtgcaggtggtctgggacagtagttcactctcaccatcacgcacgcctgcgtacgtcgtagtaagtatttagacttaatttacttactgtactagtctaagttaataaagttacgtacgtacccttaccgtaacttacgttttacggaccgtacggggaacctaacggtcgtacggacgtaacgttaaccgaaaaccggtacgtacggtacggtcgtacggtacctaaccgtacg

SEQ ID NO: 69975 - DNA, 699 bp, Homo sapiens
  misc_feature: GYAE6OF02G35V4.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaggggaaanacgcccaccctctcctgcacgggccaggtcagtagtgttagcagcgtacttagcctaggaccagcaacgaaaccgtggaccaggcctcccgaggtcctcctacgtacttcgtatggtactcgactactacccgaacgacgggacctagtacgaactacctaccccgaagtcccgtaaggtttaccgaggtacgggaccgtagggttcgggtacggtgggaactagttacgttacaccttactaccacctctacgacgacctacggtccttacgggactagttccgaaggttagtttaatttacgacgttttaaattcgttaaccgttgtacgtaacgtacgtaagtttaacgtaaccgttaacggttccggtaaccctttacggttaaccgttaaccggtttcgggaaccgtaccgggtactaacgggtaccggtagggaaccttaacgaacccggttaaagtaccggttcgggtacgtacgttacgaccccttaattccg

SEQ ID NO: 69976 - DNA, 558 bp, Homo sapiens
  misc_feature: GYAE6OF02IXY29.51.76.G10.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (380)..(380): a, c, t, g, unknown or other
  misc_feature (380)..(380): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctcaggggaaanagcccaccctctcctgcaggggccagtcagagtgttagcagcgacttagcctaggtaccagtcaagaaccgtggccaggcctccaggcctcncatctatgatcgacatccgacgacggccatgacttacnccacgtcctaggttcagtggctaggtggtcgtaggatgacgttcactctcacancgagctacgctgtacagtcacgtaagtacgtttagtacttaatttacgttacgtgtactgtacgtaagttaataacgttacgtacgttacccgttacgtaaccttcgttcggtaccgtagggtacctaggtcgtaggatactacgaacctacgtcggtacgactacgaccgtactacg

SEQ ID NO: 69977 - DNA, 666 bp, Homo sapiens
  misc_feature: GYAE6OF02JIUDX.51.76.G10.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (502)..(502): a, c, t, g, unknown or other
  misc_feature (502)..(502): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagcctacctgtctgtcgtctccgaaggggaacncgcccaccctctccgtgcgacgggccagtcagngtagttagctagcgtacttcgccgtaggtaccagacaacgaaccgtcggaccacggtcctcccgaacggtcctcctaccactcgtaactgtactgacctactaccgaacggacggcctacgtgtaactaccctacccgagtccgtacgtttaccggagtcgggacgtacgggtcggttcggacgggaactcggtacgttccactttccgacctaccgtacgtacgactaccgacggccgttacgacgttacgtaccgttataacggttnttacgtaacttaatttacgtacgtagtaccgagtacgtaacgtaattaaccgtacgttccgtaccgttaccgttaacgtacgtttacgaccggtacggtacgaaccgtcgacggtaacgacgtaaccgtaacgtcggttacgtcgtacgtacttaccgactacc

SEQ ID NO: 69978 - DNA, 709 bp, Homo sapiens
  misc_feature: GYAE6OF02IQTFA.51.76.G10.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagataccactggagaagtagtgatagacgcagtctccagccaccctgtctgtgtctaccgagggaanacgcccacccgtctcctgcagggccagtcagngtagttacgcaggccacttagccgtggtaccagacaacgaaccgtcggaccgacggccctcccgaggtccttccgactactctagtgacttcgactactaccgacgaacggcctacgtacgtactaccgtaccccgagcccgtaaggtcctaggacggtacggtacgtagggttcggggttacgtaggggaactaggttccgtacctccgttacgacctaccgtactacgacgtactacggccgtagaccgtagttaaccgtacgttagtttactttacgtaacgttttaaacttttacgttactacggtcgtaacgtaccggttaattaaccgttaaagttaccggtaccgttaacccttaccgttaaccgtttacggtttaccgggacccgtaacggggttaaccaacggttaccggacggttaacgaaccgttaaccgaacgttacggtacgtaccgggacttacggtaccgtaacg

SEQ ID NO: 69979 - DNA, 684 bp, Homo sapiens
  misc_feature: GYAE6OF02GK4YX.51.76.G10.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
tcagcgatcgtatacacgaccggtgctcgatttagtcactcatacaggggtaggaactgctcagttaggacccagacggaaccatggaacgccccagcgcagcttctcttcctcctgctactctggctcccagactaccactggagaagtagtgatgacgcagtctccagccaccctgtctagtgtctccagggggaacncgccaccctntcctgccaggggccagtccaagacgtgttacgcctagcgtacttagcctggtaccagctagaaacctggcctaggctcccaggctacctcaacgtctaactgatgccagtccaacgagggtcccaacgtcgactacgtacccagccaagggtttccagtttcgggactacggtcgggtccttaggggaccaggtacgtttccaccgttctacacccgaattccaacgcagtccctggcctacgtctacgtaacggttactttcggtacctaattttaccgttacgtacggtacctacgcctaaggttaactaaattaaaccgtcggtaccccgttaccgttaaccgtacgtttttaccgggacccgtaggggtaaccccgtagggccccgttaagggaccggtaaacttacccgtaaaaccggttaaacgttccgggttacgtaccggttaccggacccgtaacccggttaacg

SEQ ID NO: 69980 - DNA, 856 bp, Homo sapiens
  misc_feature: GYAE6OF02HC0JH.51.76.G10.1.454.CMB.1.raw
tcagcgatcgtatacacgaccggtgctcgatttagtcactcatacagggggaggaactgctcagttaggacccagacggaaccatggaacgccccagcgcagcttctcttcctcctgctactctggcctcccagactaccactggagaagtagtgatgacgctagtctccacgcctaccctgtctgtcgtctaccgaaggggaacaggccctaccctccgtccgtgaccggacgggtaccacggtcgaagtacggttaggttacgaccgacggtaccgtaacgtttacggccgttacggtaaaccacggtacccgaacggaaaccccgtacgggaccgaacgggtcccctaccccggtacggtccccttccgttactacgttacctacgttcggtactcggactaccctacccgaacggtaacggacctaacgtacgtaccgtacctaccggcgtaccgtacggttacgtacggggtcggacgtagggtcgggtacggtaacggtaacgtacggtttacgtacccaaccggtttccaacccgtaacctacggtacaacggtccgtaaccggtcccttaacgggaccttaacggtcctttaaaggggtaacttttaacggttttacgtaaaccgttttaaacgttttccgtttaacttacggttaaccttaagaaccggtttaaagtttaaaccgtaaaccggtttaacgttacccgtttacccggttaaccgttaacccgttttacgggtaccgggtaacggtacccggggaacgtaaccggtcggaacgtaaggtaacctaaccgtaaacgggttaacgtacggggtcctaacggtcgtacccgttaccgtaccg

SEQ ID NO: 69981 - DNA, 775 bp, Homo sapiens
  misc_feature: GYAE6OF02FL2DG.51.76.G10.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (328)..(328): a, c, t, g, unknown or other
  misc_feature (328)..(328): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccacgtggagaagtagtgatgacgcagtctccagccaccctgtctgtcgtctcgaaggggaaancgccaccctctcctgcgagggcagtcaggngtgtagcagcgtacttcnccgttaggaccagacaacgaaaccgtggaccgaggtccctaccccgaggcccttccgtactacgttactacgtgtacgtnaccgtaactaccgaacggtaccgggacctacgtagtaactaccgtaccgacgtaccgttaacggttctaacgggtcggtacggtaagggttccggggttacgtacggggaactaagggttacccgttacgaccttaccgttacccacgtactacgacggacacggtaccgtcgtacgaccggttactaagggttaacgtttaagttttcgtaaacttttaaacgtttttacgttacggtttagttaaccggtaactaaccggttaaagtttaaaccgttaaaccgtttacggttacccgggttacccttaacccggtttacggttttaccggtttaacgggacccgggttaacggaccggttaacggttcggaacgggttaaacgtaaccgttaaacggaaacggtttaccgggtaggtaccgggttacgtccgtaccaaggttccg

SEQ ID NO: 69982 - DNA, 677 bp, Homo sapiens
  misc_feature: GYAE6OF02ISD56.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctgcctcccagactaccacgtggacgagtagtgatgacgcacgtctccagcccacctgtctgtagtctaccgagggaacgacgcccaccctctccctgcgacgggacctagtctaggacgttggttacgcgacggacgtacgttaccgccgtacggtaccagacctaacggaaacccgttcggacctacgggtcctaccccgaggtaccctccctactacttacctagttcgagtcgaccactaccgaacgtacggccctacgtagtactaccacccgagtccgtacgttacgagtcgacgtcggttcgggtacgcgggaactagtacgttacctacctaccgaccaaacctcgtaccgaacgcctacgccgtacgtcgtacgtgtaaggtaagtttacttagtactttaactttattacgtcgtactacagtaataacgttaattcgacgttccttacgtacttacggttccgaggtacggtactaacggtcgttaacggacttaacgtaaccgaagttacggtcgtaccggtactacccggtactaccggttac

SEQ ID NO: 69983 - DNA, 714 bp, Homo sapiens
  misc_feature: GYAE6OF02G38OH.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccacccgtgtctgtgtctccgaaggggaanacgccaccctcgtcctgcgacgggccagtccagagttgttacgcagccgtacttacgccgttacggaccaggccaacgaaaacccgttgggaccctaagggtcccttccccgagggtccttccctacgtacgttcctaatcggtaactcgaccgtacgtcccgaaacggacggggtcccctaacgtggacttaacctacccgaggtcccgtaggtttccaagggtcggtacgtagggtcgggtcgtcgggaactaggttacgtccacttcgacctacgtctaccgtacgccgtaacgccgtacgacgtacgttcgtaagtaacgttctttggaacttttaagtttaccttacgttcgtacgagttaacggtaacgtttaacgaacgtttaaccgttcggtacctttacccggttacgttaccggtttacgggaccggtacgggtacgtaccggtgttaacggacgttaacgtaacgaaccgtagttcgggtacgtacgtaggtcccaagttccgg

SEQ ID NO: 69984 - DNA, 804 bp, Homo sapiens
  misc_feature: GYAE6OF02FOD6V.51.76.G10.1.454.CMB.1.raw
  modified_base (783)..(783): a, c, t, g, unknown or other
  misc_feature (783)..(783): n is a, c, g, or t
tcagcgatcgtatacacgaccggtgctcgatttagtcactcatacagggaggaactgctaagttaggacccagacggaaccatggaagccccagcgcagctctcttcctcctgctactctggctcccagataccactgagaagtatgatgacgcagtctccagccacctgtctgtgtctccaggggaaagagccaccgtctcctgccagggtcccagtccagacgtgttacgcagccgactttacgccgttggaacctaacgcaagaacctcgggccaacggcctcccccaaggggcccttcccttccaacttccgtaattacggataggtccaattcccgaaccaaaacggggtccccaaacgttcggaaacactttacccccccgaagtcccgtaacggggtttaccaggttaacggggccaacgggttcgggggtaccttcggggggacaaacgggtaccgtttacgtaaccgtccgtttacccaaccactttaaccgtacgaccgtacgtaaccccgttggacccgtaaacgtcccgttaggtaaagtaacgttttttaggtaaccttaaactttttaaacgtttaaccgttagttttaccgaaccggttaacgaaccgggttaaattaaaacgtttaaaaccgtacgggttaaccccgttacccgggtttaacccttaaccggtttttacggttaccccggaacggggggtaccctaaaggtacggtacgggtacgtaaactaaccgtaaaccgtaaaccgttaggtacggtaccgtntacccggaccttaccgttacg

SEQ ID NO: 69985 - DNA, 686 bp, Homo sapiens
  misc_feature: GYAE6OF02GVX0Q.51.76.G10.1.454.CMB.1.raw
  modified_base (121)..(121): a, c, t, g, unknown or other
  misc_feature (121)..(121): n is a, c, g, or t
  modified_base (144)..(144): a, c, t, g, unknown or other
  misc_feature (144)..(144): n is a, c, g, or t
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (498)..(498): a, c, t, g, unknown or other
  misc_feature (498)..(498): n is a, c, g, or t
  modified_base (530)..(530): a, c, t, g, unknown or other
  misc_feature (530)..(530): n is a, c, g, or t
  modified_base (668)..(668): a, c, t, g, unknown or other
  misc_feature (668)..(668): n is a, c, g, or t
tcagcgatcgtatacacgaccggtgctcgatttagtcactcatacgagggggaggaactgcgtcagttaggacccaggaccggaaccatggaacgccccagcgcagcttctcttccctctnctctctcggctcccagactaccncgtggaacgtaagtgtgatgacgcgtacgtctcccacgccctacccgttcgtcttcgttcgtccgtaccggaaggggaaacgaccggccctacccgtccttccgtcgaccgacgggtccctgtacgaggtacgttcgttacgcgtacggtccgtaacgtcgcgtaggaccacgacgtacggaccngtaccggcgaccctcgacgtaccctccgtancgttatacgtcgtacttcgacgtcctaacgacctaaccgcctagtcggtaacctcgcctaacggccttagtcgccgttcggacgttcggggtcgttcggaacggtaacggttccgtcaccgtttcacgtcgacgtacncggactcgccgtgcgtacgtctagtaccgttnttccgtaatttacttaccttcggttataccgtctaacggttattacgtactcgtcggtaccttacgtacgttaccgtagtccgtaaccggtagccggtgtaacggacctaggtaacctcgtaacccggttcccgggtntacccgtaccgtatccgg

SEQ ID NO: 69986 - DNA, 738 bp, Homo sapiens
  misc_feature: GYAE6OF02GRE8I.51.76.G10.1.454.CMB.1.raw
  modified_base (199)..(199): a, c, t, g, unknown or other
  misc_feature (199)..(199): n is a, c, g, or t
  modified_base (446)..(446): a, c, t, g, unknown or other
  misc_feature (446)..(446): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagactaccactggagaagtagtgatgacgctagtctccagccaccctgtctgtgtctccgaggggaaacncgcccaccctctccgtgccacgggccagtcgagagtgttagcagtcgacttagcccgtaggtaccagactacggaaaccgtcggacccgagggccctaccccggggctccctcgacttcgtatacggatcgcaacgtacccaaggaaccggcctactagtactcgccccaacgtccggtacgtcagggtcgctaggggtcggtcggtaggacctaagtacggttaccacgtttccaaccctaacgtntacgcggtaccgaccggtacctacggtactagggtccgtaagggttaaatttcgttttacggtaactttaaagttttacctttaaccggttcgtaacgtaaacggttacgttaaaccgttaaacgttaaaaccgttttacgtccggttaaccccgttcctttaacccggttacggtttaccgggaccgtaacgggtacccgtaagttaccggtaaacgggtaaacttaaccccgggaaaattacccgtgggtaccgttacgaacgttacccgaacttccgttacgttaccgg

SEQ ID NO: 69987 - DNA, 851 bp, Homo sapiens
  misc_feature: GYAE6OF02HJ01K.51.76.G10.1.454.CMB.1.raw
  modified_base (209)..(209): a, c, t, g, unknown or other
  misc_feature (209)..(209): n is a, c, g, or t
tcagcgatcgtatacacgaccggtgctcgatttagtcactcatacagggggagaactgctcagttaggacccagacggaaccatggaagccccagcgcagcttctcttcctcctgctactctggcctcccagataccactggagtaagtagtgatagaccgctacgtctccacgcccaccctgtctcgtgtcctaccggaaggggaacncgcccacccttctcctggcgaggcccagtcaggtatgtagcgagccgtattacgccgtagaccagaccaacgtaaaccgtcggaccagtcccctaccgcgtcccttacccgtcctaattccgtataggtactcgccaaccgttaacccgaacgggaaggtccctaacgttagtaaccttccgacccgacggtaccgtaggtttaccacgggtcggacggtacgggttcggtacgggtaggaacctaggttacccgttacctccgtacctaaccctaccagttacccgcggtaaccttaccggacccttagtaccgtacgttaacgttaaccggtttaagttaccgtttttaaggtaacctttaaacgtttttaccgtacgtttaccggtttaacgaccggtaaaccgtttaaaccgggttttagtttaaaaccctcccgggtttacccggtaaccctttttacccggtttaaacccgttttaaccggtttaaccggggccccggggttaaacgttacccgggtaacggttaacccgggttaacggtaaccggttaaaccggtaaacccggtttaaaacggtcccgggttttaacgggtacccgggttaacccgtcggtaaacccctttacccggttaacccg

SEQ ID NO: 69988 - DNA, 666 bp, Homo sapiens
  misc_feature: GYAE6OF02FPZ01.51.76.G10.1.454.CMB.1.raw
  modified_base (194)..(194): a, c, t, g, unknown or other
  misc_feature (194)..(194): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctcgagggaancgccaccctctcctgcagggccagtcagagtgttagcagcgtacgttagccgtggtaccagacagaaacccgtggaccaggcctccccgacggcctcccgtactacgttctacgtgactgccactacccgaacgaacggggtcccaacgtgtaactacctacccgacgtcccgtaggtttacgaacggtcggaccgtagggtcggggttccgtaggggaactaggtacgttaccaccgttcctaccgaacctataccagtccacgtcctgccacgttctaggtaagttattttacgactttaaattttacttactgttacacgtacctagttaattaacgttaactcggtaccgttaccgttaccgttacgttttccggaacggtacggaacctacggtacgtaacggtaacgaaccgttaacgaaacgtaccggttacggtaccggtacgtaccggtacctaccgttaccg

SEQ ID NO: 69989 - DNA, 703 bp, Homo sapiens
  misc_feature: GYAE6OF02IU6SM.51.76.G10.1.454.CMB.1.raw
  modified_base (208)..(208): a, c, t, g, unknown or other
  misc_feature (208)..(208): n is a, c, g, or t
tcagcgatcgtatacacgaccggtgctcgatttagtcactcatacagggggagactgctcagttaggacccagacggaaccatggaagccccagcgcagcttctcttcctcctgctactctggctccagataccactggagaagtagtgagtgacgctagtcctaccagccctaccctgtctggtcgttccgtaccgaaggggaaacncgacccacccttctcctgcgacgggaccacggtacgaggagttgtacgcgacgaggtactcgccgtggaccagacaagaaccgtggaccagacctaccacggtcctacctctacgttctaagtcgactcgacctaccgtaccgtaacggaaccggtcctaacgtagtaaccaccggtacccgtagtaccggtaacggttcgacggttacgggacgtacgggttacgggtacggtaggtaaccgtaggtactaccgtcctacctacacgtactcgacgcctcgaccgtgtaccgtaagtccgtaaggtacgttacttacgttacgtttaactttacgttaccgtagtaccgagttaccaagttaacgtaacgttaccgtacgttccttaacgttacgttaccgttaccgacggggacgtaacccgaggttcggaacggtaacgtacgaacgtaacggttaccggtagtaccggtcctaaccgtcccgattaaccgg

SEQ ID NO: 69990 - DNA, 721 bp, Homo sapiens
  misc_feature: GYAE6OF02GTAYN.51.76.G10.1.454.CMB.1.raw
  modified_base (192)..(192): a, c, t, g, unknown or other
  misc_feature (192)..(192): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggaagaagtgtgatcgaacgctagtcctccacgcccacccttgtcctggtntcctaccgaaggggaaactcgcccctacctctccgtcggcacgggccagtcgaaggtagttagtaggcctagggcctaactttacggacctcggtaaccacgacgaaacgtaaccgtcggccgtaacggccttaccgaacgggtccctcctacgtaactacgttaacgcgtaactcggacaccttaaccgaacgggtaaacggcctaactacggtaacctccgtaccgacgtaccgttaaggtcgtagtcggagtacggtcggtacggagacgtaacgtcgttaccaccgttcaccgtactagtcacgtcgaacgtcctagaccgtagtaccgtagaatttaccgttataccgtttaaatttcgttagtctacgaacgttacgaacgttaaatttacgaacttacccggctttaacccgtacgttaccggttacggtaccgtaccgggttaacgacgttggtaacggtaactaaccgtaacgtaaacccgttagtaccgggttgtacctaccgtaccctaaccggttac

SEQ ID NO: 69991 - DNA, 712 bp, Homo sapiens
  misc_feature: GYAE6OF02HBXAV.51.76.G10.1.454.CMB.1.raw
  modified_base (200)..(200): a, c, t, g, unknown or other
  misc_feature (200)..(200): n is a, c, g, or t
  modified_base (319)..(319): a, c, t, g, unknown or other
  misc_feature (319)..(319): n is a, c, g, or t
  modified_base (383)..(383): a, c, t, g, unknown or other
  misc_feature (383)..(383): n is a, c, g, or t
  modified_base (457)..(457): a, c, t, g, unknown or other
  misc_feature (457)..(457): n is a, c, g, or t
tcagcgatcgtatacacgaccggtgctcgatttagtcactcatacagggggaggaactgctcagttaggacccagacggaaccatggaagccccagcgcagcttctcttcctcctgctactcgtggctcccagataccactggagaagtagtgatgacgcagtctccagccacctgtctgtgtacctccgaaggggaaancgtccaccctctccgtgaccgacgggccagtcgagagtgttacgcagcgtacttacgccgttggaccagaccaaggtaaaccgtggacctagggtccctccccggaggtcccttccctntaaccgttctaagtcgtaatcgacacgttacccaaggaacgggtaccctaagtgtaacttaccncccgaagtccgtaggttcgaaggttggacgtacggggttggcgtaggggactaaggttacgttacctcgttacnccgtaacactcgaacgtcgacgtctaggtacgtaggtactaaggttacgtttaaggttactaactttaaacttttacgttacgttgacgttaacgtcgttaaacgttaacttaacgttaaccgtacggtaccctttaccggttaacttacggtttacggaccgggtacgggtaactacgggtacgttaggaacgtaactttaaaccggaacgtacggtttacggcggttaaccgtccggtaacctaccggttacg

SEQ ID NO: 69992 - DNA, 824 bp, Homo sapiens
  misc_feature: GYAE6OF02G0CKA.51.76.G10.1.454.CMB.1.raw
  modified_base (201)..(201): a, c, t, g, unknown or other
  misc_feature (201)..(201): n is a, c, g, or t
  modified_base (247)..(247): a, c, t, g, unknown or other
  misc_feature (247)..(247): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccacgtggagaagtagtgatgacgcagtcctccgagcccaccctgtctgtgtctccgaggggaaanacgcccaccctctcctgcgacgggccaggtcaggtagtcggttacncgagaccgtacgttacgccgtcggtaaccagacaacgaacccgtcggaccgacggcctccccgaagggccctccgtaccacgtctacgtcgaacgtcgcctaactaccaaccggaacgggtcccaacgttagtaactccgaccctaggacccgtaacggtttcgacgggttcggtaccgtacggggtacggggttaccgacggggtaagtacgggttacggtttaccctacccggttacccttaacccgtaacccgtaacgtacccgtaccggtaccgacccggtacccgttaccggtcgtaaacgggttacccggttaaggttaaaccggtttagttttaacccgttaaattttaaacttttacgttaacccgttacggttaaccgacgttaaaccggttaagtttaaaccgttaaaggtttaccgttaacccgggtttaacccgttaaaccggtttacccggtttaaacccgtttaccggggtacccggtaacggggtacctaaacgggtcggtaacggtaacgtacgtaaaccgtaacgtacggtaggtaccggtctaccggtactaccgtacg

SEQ ID NO: 69993 - DNA, 653 bp, Homo sapiens
  misc_feature: GYAE6OF02FJV2X.51.76.G10.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtccagagtgttagcagcgacttagcctaggtaccagcagaaaccctggccaggcctcccgaggtcctccctnactctatgatcgcactccaacgacgggccacgtgatacgtcccagccctaggtttcaggtggctagggtcgggtcgtaggggactacggtacgttaccacgttccgtaccacctacgtcgacgccgtacgtacccttcgcctacggttcgtagtaagttacgtttttcgactttaaggttttatttacgttcgtacgtacgacgtacgtaacggtaaaactaaccggttcggtacccgttaccgtttacgggaccgtttaccgggacccggaacgggtaaccggtaacgggttaacggaaacgtaaccggtaaaacggtacgtagggtacggtacgtacgacgacctacgtcgttaccgg

SEQ ID NO: 69994 - DNA, 782 bp, Homo sapiens
  misc_feature: GYAE6OF02I67X0.51.76.G10.1.454.CMB.1.raw
  modified_base (209)..(209): a, c, t, g, unknown or other
  misc_feature (209)..(209): n is a, c, g, or t
  modified_base (418)..(418): a, c, t, g, unknown or other
  misc_feature (418)..(418): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
tcagcgatcgtatacacgaccggtgctcgatttagtcactcatacagggggaggaactgctcagttaggacccagacggaaccatggaagccccagcgcagcttctcttcctcctgcttactctggcctcccagataccactgggaagtaagtaggtgaactgacgcagtcctccagcccacctgtctgtcgtctaccggaaggggaanacgcccctacccgtctaccgtgaccgtacgggcccaggtccaggtaggttcgttacggcctaggccgtaactttacggcccgttcggtaccagaccgtaacggtaaacccgtcggaccgacgggtccctccccggaggtccctaccgtcaacgtttactaggtcgacgttgacctacgtaaccgaagaaccgggcctacgtagtaaccncgtacccagtaccgtggttacgaggtcgacggtagggtggttacgngggactagtnttaccacttcgtaccagtactacgacgcgacgtctgtactacgtcgtaacgttagttcgttacgtaacctttatttacgtaaccgtcgtacgtaacgttaccgttaagttaacgtaacgtttaccgtaacccgggttccttaacccgtttacgtttacccgggtttacgaacccgggttacggggtaacctttacggggtacccgtttaaacgggtaacgttaaaccggttaaaacccgaaaccgggttttacgggtacgggtttaacccggaccggtttaccgtaaacccggttacccgttaaccgg

SEQ ID NO: 69995 - DNA, 634 bp, Homo sapiens
  misc_feature: GYAE6OF02FS55G.51.76.G10.1.454.CMB.1.raw
  modified_base (202)..(202): a, c, t, g, unknown or other
  misc_feature (202)..(202): n is a, c, g, or t
tcagcgatcgtatacacgaccggtgctcgatttagtcactcatacaggggggaggaactgctcagttaggacccagacggaaccatgggaagccccagcgcagcttctcttcctcctgctactctggctcccagactaccactggagaagtagtgatgacgcagtctccagccaccctgtctgtcgtctccgaggggaaacncgaccaccctctcctggcacggggccagtcaggagtgttacgctaggacgtacttagcctggtaccagacctaacgaaaccgtggaccaggtcctacccgaggtcctcctacgtacttctagttcgactcgacctactaccgaacgacgggccacgtagactactcccgagtccgtaggttcgagttcggacgtagggtcggtacgtcggggaactggtacttccgtactaccgtactaccgatccgagtaccacgctgctaggtactagtagttctttcgatttaatttcgatcgtacagtactagttaatacgtacgtccgttaccctcgttaccgttagttacccggagttacgggaacccagggttccaagggtaactaccgttaaacgacggtaccgtggtaccggtactcggtaccctacttacgg

SEQ ID NO: 69996 - DNA, 700 bp, Homo sapiens
  misc_feature: GYAE6OF02HKSCP.51.76.G10.1.454.CMB.1.raw
  modified_base (165)..(165): a, c, t, g, unknown or other
  misc_feature (165)..(165): n is a, c, g, or t
  modified_base (266)..(266): a, c, t, g, unknown or other
  misc_feature (266)..(266): n is a, c, g, or t
  modified_base (524)..(524): a, c, t, g, unknown or other
  misc_feature (524)..(524): n is a, c, g, or t
tcagcgatcgtatacacgaccggtgctcgatttagtcactcatacaggggaggaactgctcagttaggacccagacggaaccatggaagccccagcgcacgcttctcttcctctgctactctggcctcccagtacaccacgtggaacgaagtagtgaatgaccgnagtctccagaccctccgtgtcgtgtcgctaccgaaggggaaacacgtcccaaccttccgtcgtccgacggaacgggcctaagtccgagtattggttaaccncgaagccgtatttaacgccgttacggtaccagtcgaaacgtaaccgcggacgaacgtccgtaccgacgtccgtaccgtactaccgtctacgtatacgtctacgtaacgtacccaacggaccgggacctaaccgtagtaaccgttaaccgttcccgaacgtcccggttaaacggttcgtaacgggtcggacgttacggtacggtcggtacgggactaagtctaccgtactacctcgaacagtctaacgccgaatccgtnacgagtaccagtagtacttacgtacgttaatttactactggctaacgtacgtaacgtattaacgtacgttcggaccttacggtactaacgttccggtacgaccgttaacggcgtacgttacgaaccttaagaacgttaaacgcggttaacgcggttaacctgacccgttactacgg

SEQ ID NO: 69997 - DNA, 788 bp, Homo sapiens
  misc_feature: GYAE6OF02H437G.51.76.G10.1.454.CMB.1.raw
  modified_base (174)..(174): a, c, t, g, unknown or other
  misc_feature (174)..(174): n is a, c, g, or t
  modified_base (194)..(194): a, c, t, g, unknown or other
  misc_feature (194)..(194): n is a, c, g, or t
  modified_base (225)..(225): a, c, t, g, unknown or other
  misc_feature (225)..(225): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtctccagccacctntctgtgtctccgaggggaancgccaccctctcctgcgacgggccagtcagngtgttagcagcgtactagccgtaggtaccagcaacgtaaccgtggaccaggcctcccgaggccttccgtactataccttatagtactcgactacaccgaacggaacgggtacccaacgttgaactaccgtccccgaaggtacccgtaggttacgtaggtacgggtcgtaggggttcgggttacggtacggggacgtaacggttacggtttacctaccgttcctaaccgacctatacccgaggcccgtacgccgtaggtacgtaccgttacgtacggtaaaggtttactttacggtaactttaattttacgtttacgtcgttacgtacgtacgttaaagtttaaacgtaaaccgttaaccggttccggttacccgtttaccgttaaaccggtttttaaccgggtttaccgggttaacccgggtaaccgggggtaaacccgtttaacgggtaccggttaaacccgggggtaagttaaaacccggttaaaccggtaaaaacccggttacgggtttaaccggttaccgggttaacccggttaccgtaccccgtaacggtttaacccg

SEQ ID NO: 69998 - DNA, 772 bp, Homo sapiens
  misc_feature: GYAE6OF02GNO2M.51.76.G10.1.454.CMB.1.raw
  modified_base (205)..(205): a, c, t, g, unknown or other
  misc_feature (205)..(205): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagtaagtagtgatgacgcagtcctccagccaccctgtcctgtcgtcctccggaagggaaacncgcccaccctctcctgcgacgggccagtcgagtaggttgttagcgaacggccgtaacgttacggccgttgggtaacccaggaccgaaacgtaaacccgtcggacccgacggtccctaccccggaggttccctaccctactacgttacgtagtgtaactcgacctactacccgaacggtacggtaccctagttagactaccgtaccccgaggtaccccgttaggttaccgacgggttcggtaaccgttaggggtttacgggtccgttaaggggaacccgtttaaggtaccgttttacccgaccgtttcccgaacgtaaccccgtagttacccgacgtacccgtaccggtcccgtcgtaccgtaggttacgtagttaacgtttagtttacgaacgttttaacttacgttatcgtaacgttagtacgtaattaacgtaactacgtccgttaaccgttcgttaaccttacggtttaccgacccggtacgggtaaccacggttccggtaggaaccgtaactaaccggtaacggttactaggggtaccgtaccgtacgtaacccgtgttaacc

SEQ ID NO: 69999 - DNA, 869 bp, Homo sapiens
  misc_feature: GYAE6OF02GNCXR.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggaagaagtagtgatgacgcagtctccgagccacctgtctgtgtctaccgaggggaacncgccaccctctccgtgcgacggccagtcagtagtgtagcagtcgacttacgcctggaccagaccgaacgaaaccgtggacccgacggtcctacccgacggtcctcctactcttactagtacgtatacgacctacgtaccaaccggtaacgggacctacgtacgtaacgtacctcccgaacgtacccggtaacggttaccgtaggtccgggtaaggtacgggtttcgggggttaccggttaacggggaacgttacgggtacgtttacgtacccgttaccgtaccgaaccctacgtacgtaccgacggttaaccgccgttacgaacgttaccgggttacgttaacgttacggtttaacgttttaaccgttaacgtttaaacgtttttaccgttaacgtttaccggtaccgttaacgtaaccggttaaagttttaaacccgtaaacggtttaacccggttacccgggtttaacccgttaaccccggttttaaaccggtttaacccggggtttaaccgggtaaccccggggttaaaccggggtacccggttaaacgggttacgggttaaaccgggtaactaaaccccgggtttaaacccggtaaaacggtttacccggggttagggtttaaacccgggcccgtttaaccggttaaccccgtacccggtttaacg

SEQ ID NO: 70000 - DNA, 816 bp, Homo sapiens
  misc_feature: GYAE6OF02FTH00.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctcccagataccactggagaagtagtgatgacgcagtcctccagcccaccctgtctgtgtctccgaaggggaancgcccaccctctcctgcgacgggccagtcaggtagttgttagcacgacgtacttacggccgtcggtaccgaggacctaacggtaaacccgtcgggacccgtaccggtaccctccccgtacgggtcccttaccccgtacctacgttacctagtacggtacttacgacctaaccgtaccccgtaaaccggaacccgggtaccctaacgttacggtaacttaccccgtacccgaccggtacccgtacgggttacgacgggttcgggacggtacggggtttcggggtacggttacggggaaccgttaggtaccggtttaccaccgtttcccgtaaaccacccgttacgtacccgaacggtaccaccgggtaccgttcgaccgtaacggttaccggttaacgttaacggtttacgttttaacgtaaccttttaaacgttttacgtttaccgtagttaaccgaacggttaactaaaggtttaacctaacgtttaaccggtccgttacccttaaccggtttaccgttacggtttacccgggacggtacccgggactaacggtcggaacggtaactaacgtaaaccggtacgtacgttacggtaccgcgtacgacccgtacgtacg

SEQ ID NO: 70001 - DNA, 731 bp, Homo sapiens
  misc_feature: GYAE6OF02HXJM0.51.76.G10.1.454.CMB.1.raw
  modified_base (144)..(144): a, c, t, g, unknown or other
  misc_feature (144)..(144): n is a, c, g, or t
  modified_base (196)..(196): a, c, t, g, unknown or other
  misc_feature (196)..(196): n is a, c, g, or t
  modified_base (663)..(663): a, c, t, g, unknown or other
  misc_feature (663)..(663): n is a, c, g, or t
  modified_base (715)..(715): a, c, t, g, unknown or other
  misc_feature (715)..(715): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgganaagtagtgatgacgcagtctccagcccaccctgtctgtgtctacgagggaancgcccacctctccgtgcgacggaccagtacgagtagttaggttaacgcgaggtaccgtacgttacggccgttacggtaaccaacggaccgtaaacgtaaaaccggtcggaacccgtacggtaccctacccggacggtccctaccgtagtaacgttaccttaacgtagtactacggacctaacctaccgaacggaacggtaccctacgtacgtaacgtaccgtacccgacgtaccgtaacgttcgtaagtcggacgtagggttcggtacggtacgggaacgagttacgttacctaccgtaccgtacgaaacctagtccgtaacgctaacgtcgtagccgtagtaactacggtaattacgtttacgtactttaatttacgtaacgtcgtaaccgtaggtaaacctaagttaaactaacgtaaccgttcggtaccctacggttaactacggttacggacgtacgggaacnggtaaccgtaggtaatacgtaaaccgaacggtacgttgggaaccgccgttanacccgtaaccgttacg

SEQ ID NO: 70002 - DNA, 762 bp, Homo sapiens
  misc_feature: GYAE6OF02FMGP2.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtgtgatgacgcagtctcagcctacctgtctgtgtcctacgaggggaaancgcccacctgtcctgccgacgggcctaggtcacggagttggtacgcgacgtcgtaaccttacggccgtaggtaccgaggacaacggaaaccgtggacctaacggccttccccggaggtcccttccgtacctacgtttacgtaacgagtactccggacctaaccgtaccgaaaccgtaaaccgggaccgtacgtacggaacttaaccgttcccgaacgttcccggtaacggtttaccgacgggtcgggtacgtaacgggtttcgggtctacgggggtaactacgggttacgttacccgtaaaccgttccgtaaccgtaccgtaacgtaccggtacgtaccgtaacgttacccgtagtaccgtacggttacgtacggtagttactttacgtactttaacgtttaacgttaccgttcgtacgtacgttacgttaacgttaagttaacgtacgttacgtcccgttaaccttacgttacgtttacgggaccgtacgggtaacctacggtcggtacgtaccgtaagttaccgaaccggttagttacggcgttacgacgtactacccgtacg

SEQ ID NO: 70003 - DNA, 632 bp, Homo sapiens
  misc_feature: GYAE6OF02HRRK8.51.76.G10.1.454.CMB.1.raw
  modified_base (424)..(424): a, c, t, g, unknown or other
  misc_feature (424)..(424): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcgagagtgttagcagcgacttgcctggtaccagcaacgaaacctcggaccacggcctacccaggcctcctcatctatgatcgcactccaacgacggcctagtgactactaccgacgtaccgtagttcgaggtcggtacgagggttcgggtcgtacgggtacgtacgtagttcctaccgtcgtacccgaccgacgtacgtacncgtacgccgtcgtacgtacgtcgtaacgtagttacgtttcgaactttaacttttacgttacgtacgttcgacgtactaacgttaagtaacgtaccgtcgtacccgttacgttactaccgggttttcgaaccggtacgggaacacggtcggtacggtacgtaacgttaacgaacggttacgtacggtacggtccgtacgtacctactcg

SEQ ID NO: 70004 - DNA, 692 bp, Homo sapiens
  misc_feature: GYAE6OF02FGXSA.51.76.G10.1.454.CMB.1.raw
  modified_base (201)..(201): a, c, t, g, unknown or other
  misc_feature (201)..(201): n is a, c, g, or t
  modified_base (661)..(661): a, c, t, g, unknown or other
  misc_feature (661)..(661): n is a, c, g, or t
tcagcgatcgtatacacgaccggtgctcgatttagtcactcatacagggggaggaactgctcagttaggacccagacggaaccatggaagccccagcgcagcttctcttccctcctgctactctggcctcccagataccactggagaagtagtgatgacgcagtctccagccaccctgtctgtgtcctccgaaggggaaanacgcccaccctctcctggcacgggccagtcagagtgttagcagcgacttagccgtggtaccagaccagaacctggaccaggccctaccgacggcctcccgtcacgttctagtgatgacctactacccgaacggaacgggcccaattacgaacttaccgtacccacggtaccgtacggtttcgacggtcggccgtagggtggggtccgttagggaaccgtaggttacggttccaccgttcctaccgaacctacgtcgaaccgtcgacgtcccgttaggccgtacgttaccgtaaggtaaacgtttaccgtttagtaaccctttaagttttaacttaccgttacgtactaacggtactaaggttaactaacgttaacgtccgtacctccgttaacgtcgtttaccggacgtacgggaacctacggtacggtacgaactaccgttaaccgaacggttaccggnggttaccggacttaccggcctaaccttacgg

SEQ ID NO: 70005 - DNA, 730 bp, Homo sapiens
  misc_feature: GYAE6OF02F0DI0.51.76.G10.1.454.CMB.1.raw
tcagcgatcgtatacacgaccggtgctcgatttagtcactcatacgagggggaggaactgctcagttaggacccagacggaaccatggaagccccagcgcagcttctcttcctcctgctactctggctacccagataccactggagaagtagtgatgacgcagtctccagccacccgtgtctgtgtctgtaaggggaacacgccaccctctcctgcagggccagtcaggtagtgtagcacgcgtacttagccgtggtaccagacaacgaaccgtggacctacggcctacccgaggtcctcccgttacgacttaccgtagtacgtacgttcgactaactaccgaacgacgggtaccacttagactacgtacccagtccgtaggtcaggtcggtacgacgggttgggtacgtacgggaactagggtacgtacctacgtccgaccgaacttacgacgtaacgaccgtaacgtccgtacgtacgtaacggttacgtaaggttacgtttaagtttcggtaaactttaacgtttaacttcgtagttaaccgacgtaaccgtaaggttaacttaacggtacttaccgggttacccgttaaccgttacgttacggtttcgggaaccggaacggggtaacccaagggtaccgtttacgggaaaacgttaccgtaaaaccgtaaccggtttaacggtacggttaccgggtaaccgtaccgtaacccctaagggttaaccc

SEQ ID NO: 70006 - DNA, 880 bp, Homo sapiens
  misc_feature: GYAE6OF02G4KX9.51.76.G10.1.454.CMB.1.raw
  modified_base (787)..(787): a, c, t, g, unknown or other
  misc_feature (787)..(787): n is a, c, g, or t
tcagcgatcgtatacacgaccggtgctcgatttagtcactcatacagggggagggaactgctcagttaggacccagacggaaccatggaagccccagcgcagcttctcttcctcctgctactctggacctcccagataccacgtggagagtagtgatgacgcagtctaccgagcccaccctgtctgtcgtctaccggaaggggaaagcgacccgtaccctcgtaccgtgaccgacgggccctaggtacgaggtacgtggttacgacgtacgaccgtacgttacgccgttacgggtaccaaggaccgaacggtaaacccgtcgggacccgtaacgggtcccctaccccggaggttcccctaccccgtacgtacgtttaacgtaacgttcggtacgttaccggacctaccgttaaccccggaaacgggaaaccggggtacccttaacggttacggtaaccgttaacccccgtaccggaaacccggttaccggttaaaccggtttacgaacggggtttccggggacggttacgggggtttttaacgggtaaccgtaagggggtaaaccgtaccgggttttaaaccggttaccctaaacccgttccccgtaaaccggtaccctaaccgggtacctaaccggtcccggtaaacggtcccttaacggtaccgtacggtttacccggtaagtttaaacggtttacttttaccgtaaagttttaaactttacggttaccgtaacgttacggacttacgtaaagttaacgtacgtacgtccgttacttaaccgttnttaccggttacggacgttaaccggtcaggtccgaaggtacgtaacgaaccggtaagtaccggtgtaccggtacccgtacgaccgtagtacccg

SEQ ID NO: 70007 - DNA, 627 bp, Homo sapiens
  misc_feature: GYAE6OF02F2BQV.51.76.G10.1.454.CMB.1.raw
  modified_base (197)..(197): a, c, t, g, unknown or other
  misc_feature (197)..(197): n is a, c, g, or t
  modified_base (229)..(229): a, c, t, g, unknown or other
  misc_feature (229)..(229): n is a, c, g, or t
  modified_base (347)..(347): a, c, t, g, unknown or other
  misc_feature (347)..(347): n is a, c, g, or t
tcagcgatcgtatacacgaccggtgctcgatttagtcactcatacagggggagaactgctcagttaggacccagacggaaccatggaagccccagcgcagcttctcttcctcctgctactctggctcccagataccactggagaagtagtgatgacgcagtctccagccaccctgtctgtcgtctccgaggggaaancgcccaccctctcctgcgacgggccagtcagngtgtagcagcgtacttagccgtggaccagacaacgaaccgtggaccgaggcctacccgagtcctcctctagtctagtgatcgaccactaccgaagaacggccctaatcgtaactaccncccgaagtcccgtaggttcgaggtcggccgtagggttcgggtcgttagggaacgtaggttacgttaccaccgttctaccgaactcgtaccgacgaccgacgccgtagacgtacgtcgtaaggtacgttagtttacgactttaatttacgtacgttgtacgagttacgtaagttaattaacgtacgtcgtacccttacgttacgttacgttccggacggtacgtaaccgagtcgtaggtactaacgtacgaaacgtcgtagtcgactcggtacctactacg

SEQ ID NO: 70008 - DNA, 778 bp, Homo sapiens
  misc_feature: GYAE6OF02I5Y21.51.76.G10.1.454.CMB.1.raw
  modified_base (145)..(145): a, c, t, g, unknown or other
  misc_feature (145)..(145): n is a, c, g, or t
  modified_base (208)..(208): a, c, t, g, unknown or other
  misc_feature (208)..(208): n is a, c, g, or t
  modified_base (736)..(736): a, c, t, g, unknown or other
  misc_feature (736)..(736): n is a, c, g, or t
tcagcgatcgtatacacgaccggtgctcgatttagtcactcatacagggggaggaactgctcagttaggacccagacggaaccatggaagccccagcgcagcttctcttcctcctgcttactctggctcccagataccactgganaagtagttgatgacgcagtactccacgccaccctgtctagtcgtacgtaccggaaggggaacnccgaccctaccctcgtccgtggccgacggccagtacgagtagtgtacgcgagtacgtactacgccgtagtaaccagacgtaacgtaaccgtcggaacccgacggtccgtacccgtacggtcccttcccgtagtaaccttcgtaactaggtacttaccgtacctaaccgtacccgaacgggtaacgggtacccctaacgtacgtacgtaacctaccccggtaggtacccgtacgggttaccgtacggttcggggacccgttaaggggttcggggtaccgtaacggggtaacctgttaacccgttaccgtaacccgttaccgaacccgtaccctagttaacccgacggttacccgaaccggtcgtaaccggttactacggttacgtaaagtttaactttacgtttagtacctttaagtttaccgttaaccgtagtacaacgttactaacggttaccttaacgtacgttccgtaccgttacgttacggtccgttagggacccgtacgtaacgacgtacggagtaacgttanaaccgtaactccggtagtaccgtctaccgtaccactttaccg

SEQ ID NO: 70009 - DNA, 803 bp, Homo sapiens
  misc_feature: GYAE6OF02GP67Y.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtcgtctccggaggggaaacngccaccctctcctgcagggaccagtcaggtagtgttagcagcgtacttagccgtaggtaccagacgaacgaaaccgtcggaccacggtcctcccgacggtcctaccctacacttccgtagtacggtactcggaccttaacgacccgtaaacggaaccgggcctaacgtacggtaaccgttaccgtaccccgaacggtcccggttaaggttaccgtacgggtacgggtacggttggggttccggggtacggtaacgggggaacttacgggttaacgtttacccgtacgttacccgtttaaccaaccgttaacgttaccggacggtaaccgtacggtacccgtagtaccgtaacgttaccgttaaggtacgtttaacggtttactaacgtttttaacgttttacttaacgttacggtactaaacgttagttaaacgtttaattaaaccgttacggttaccggttaacccgtttaccggttaacccggttaacggtttaccggggaaccggttaacggggaacctaacgggtacgtaaacggaacttaacgaaaccggttaaaggtaccggtggttaaccggcgttacccgaccggttacttacg

SEQ ID NO: 70010 - DNA, 689 bp, Homo sapiens
  misc_feature: GYAE6OF02JDO2C.51.76.G10.1.454.CMB.1.raw
  modified_base (164)..(164): a, c, t, g, unknown or other
  misc_feature (164)..(164): n is a, c, g, or t
  modified_base (180)..(180): a, c, t, g, unknown or other
  misc_feature (180)..(180): n is a, c, g, or t
  modified_base (193)..(193): a, c, t, g, unknown or other
  misc_feature (193)..(193): n is a, c, g, or t
  modified_base (283)..(283): a, c, t, g, unknown or other
  misc_feature (283)..(283): n is a, c, g, or t
  modified_base (443)..(443): a, c, t, g, unknown or other
  misc_feature (443)..(443): n is a, c, g, or t
tcagcgatcgtatacacgaccggtgctcgatttagtcactcatacagggggaggaactgctcagttagacccagacggaaccatggaagccccagcgcagcttctcttcctcctgctactctggctcccagactaccactggagaagtagtgatgacgcagtcncagccacctgtctgtntctcgagggaacncgccacctctcctgcgagggccagtacagtacgttgttacgcgtagcgtactcgccgttggacagacacgaacctggaccaggcctccgnggctcctatcgtctaagcgagtcgactacgtaccgaacgacggtacctacgtagaactacctacccgagtaccggtacggttacgacgtcggaccgttaagggtttcggtacggacgggaactagtccgttactaccgtcaccgtacctacgtaccgaanccgtacgtccgtacgtacgtacgttacgtaacgttaacggtttcttaacggttacttttaaagtttaccgttaacgttacgtacggtaacctaacggtttaagttaaaccgtaacgttaaccggtaccggtttacccgtaacgtttacccggttacgttttaaccgggaccgtaacggtaccgtacggtacggtaaggtactaacgtaacgtaacgtacgttcgacggtcctacgactacgttacg

SEQ ID NO: 70011 - DNA, 692 bp, Homo sapiens
  misc_feature: GYAE6OF02F3CJM.51.76.G10.1.454.CMB.1.raw
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccctgtctgtgtctccgaaggggaaancgcccaccctctcctgcgagggccagtcagagtgttancagacgtacttagcctaggtaccagaccagaaacctggaccaggacctcccgaacggccttaccctctaacttacgtactaggtactagacctacgtacccgaaacgaacggggacccaaccgttagaacttaaccgtccccgaacggacccgtaaggtttaccgaaggttcggacgtagggttcgggtacggtaggggacctaagggtacgttaccacgtcctacaccgtactcgacgtacgacgtctgacgtacgttacgtaacggtaagtttactttacggtaactttaactttttaagtaccgttagtagtaccggtaataacgttaagtaaacttaaccggtacgtacccttacgttaaccgtttactttaccgggaccacgggtaaccaacggtccgtagggaactaacgtacgtaaacgtacgtacggtcgtacgtacgtacactacg

SEQ ID NO: 70012 - DNA, 753 bp, Homo sapiens
  misc_feature: GYAE6OF02G00HJ.51.76.G10.1.454.CMB.1.raw
  modified_base (207)..(207): a, c, t, g, unknown or other
  misc_feature (207)..(207): n is a, c, g, or t
  modified_base (712)..(712): a, c, t, g, unknown or other
  misc_feature (712)..(712): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgtcagtcctccagacccaccctgtctgtacgtcctacgaaggggaacncgccctacccgttctaccgtggcgacgggccaggtcaaggtagtacgttacgcgtacgaccgtacgttacggccgtacggtaaccagaccgaacggtaacccgtcggggacccacgggtccctaccccggagggtcccctaccgttaccgtactttaccgtaacggtagtacttacggtacctaaccgtacccgaaccgggtaaccgggacctaaccgttaggtaacccttacccgaccccggacgtacccgttacggtttacgacgggttcggtacggtacggggtttcgggtacggtacggaacgtacggttacgttacacccggttacctaccacctacgttaccgacgtaccgtacgaccgtacgacgtacgttacgtagtaaggtttacttaacgtacttttaacgtttatacttacgtagtacttacgtaatttaactacgttaccgtacgttacccgttacgtaccgttacgtacggaccgtacggtactcgggtaanacggataacgaaccgtagacgtgtacgctagaccctagtac

SEQ ID NO: 70013 - DNA, 661 bp, Homo sapiens
  misc_feature: GYAE6OF02HNS8H.51.76.G10.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgganaagtagtgatgacgcagtctccagccaccctgtctgtgtcctccgaaggggaaancgcccaccctctcctgcacgggccagtcagtagtgttagcagcgacttagccgtagtaccagacaacgaaaccgtcggaccgaggcctacccgaggcctcccgtcacttactagtgactgcctactcccaacgaacgggcccactagtaactaccgtcccgagtaccgtacggttacagggtcggacgttagggtcgggttacggtacgggaactagtacggttccacgttcctaccgaacctacgtacgaccgcgaccgcctacggacctacggttcgtaagttaagttactttacgtactttaagtttttaacctcgttacgtacgtagtaccgttaattaacttaaacgtaccgttacgtacccttaccgttaccttacggtttccggacggtacggtacctaaggtcggtaggacgtaacgacgtaaacgtcgtcggtaccgcgtctaccgtcgtacg

SEQ ID NO: 70014 - DNA, 843 bp, Homo sapiens
  misc_feature: GYAE6OF02I4UXZ.51.76.G10.1.454.CMB.1.raw
  modified_base (153)..(153): a, c, t, g, unknown or other
  misc_feature (153)..(153): n is a, c, g, or t
  modified_base (166)..(166): a, c, t, g, unknown or other
  misc_feature (166)..(166): n is a, c, g, or t
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (473)..(473): a, c, t, g, unknown or other
  misc_feature (473)..(473): n is a, c, g, or t
  modified_base (774)..(774): a, c, t, g, unknown or other
  misc_feature (774)..(774): n is a, c, g, or t
tcagcgatcgtatacacgaccggtgctcgatttagtcactcatacagggggaggaactgctcagttaggacccagacggaaccatggaagccccagcgcagcttctcttcctccctgctactctggctcccagataccatggagaagtagtgntagacgcagtccnccacgccaccctgtctgtgtctccgagggaaatcggccaccctctcctgcgagggcctagtcgagtagttcggtagacaggccgtaacttcgaccgtacggtaccacgacgaaccgtaaccgtcggacctacgggcctacccgacgtcctcctacgntactcgtagtgngaccacgtaccgaaccgaccgggtacacgtacggacttaccctcccgtacggtacggtccggtagtacggggaacggtcggtacggtttaggggtcggtaagggtacggtaccggttaacttacccgtacgtttaccnccggtaaaacctcggttaaccacccggtacctaccggtacccttaacgggtacccgtacgtttacggtaaaccggttaaacggtttacttttaaaccgtaacgttttaacgttttaacctttaccgttaccggtaacgttaccgtaagtttaaacggtttaacctttaaaggttaaccggggtttacccctaacccggtttaacccgtttaacggttttaaccccgggttacggggtaaaccccgggaacccgggtacccgggttaaaagtcccggggtttaacggtaaacccggttaaanaaccccgggttaaacggtaacgggtacgggtttaccgacccggttacggaacccggttatttaacccgg

SEQ ID NO: 70015 - DNA, 858 bp, Homo sapiens
  misc_feature: GYAE6OF02GMPGP.51.76.G10.1.454.CMB.1.raw
  modified_base (662)..(662): a, c, t, g, unknown or other
  misc_feature (662)..(662): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactgggaagaagtagtagagtcgacgacagtcctaccgagccctaccctgtccgtggttctacgtaccggaagggggaaacacgcccctaccccttaccgtcctaggaccgacgggaccctaggtaccacggtacggttagttacggaccacgtcgtaaacgtttccgaccggttacggtaacccgagaccgtaaacggtaaaccgtcgggaacctacggtacctaaccccggagtcccttacccgtactaaccgtacttagtacgtaacgttcgacctaaccgtaccggaacggtaaccggtcccgtaacgttaggtaaaccttaccgtaccccggtacgtaacccgggttacggtttaaccgaacggggttcgggtaccggttaggggtttccgggtaaccggggtagggtaacccgtacgggtttaaccgttacccttacccgtaaccctacgtaacccgtacgtaccgacgtaccgacgtcccgtaggtacctacggtacgtagtaacgtttacgtttntaaacgtttactttaccgttagtacgtacctaaggtaccttaagtaccttaaggtacccgtacgttacccgttaacgttaccgttacggtttaccggaccgtaccggtacctacgggtaacctacggtaacgtaccgttaaaccgacggttacgggttacgacccggttacgtaaccgtacggttacgttaaccgg

SEQ ID NO: 70016 - DNA, 800 bp, Homo sapiens
  misc_feature: GYAE6OF02H03S5.51.76.G10.1.454.CMB.1.raw
  modified_base (173)..(173): a, c, t, g, unknown or other
  misc_feature (173)..(173): n is a, c, g, or t
  modified_base (199)..(199): a, c, t, g, unknown or other
  misc_feature (199)..(199): n is a, c, g, or t
  modified_base (532)..(532): a, c, t, g, unknown or other
  misc_feature (532)..(532): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccacgttggagaagtagtgatgacgctagtctccganccacctgctgtcgtctcggagggaancgcccgtaccctctcccgtgaccgtagggaccctacgtaccgaggtaaggtttcgttacgaccgacgtccggtaacttacggccgttacggtaaccacgaccgtaacggaaacccggttgggaccccgtaagggtccccctccgacggtccttacccgtctaactcctagtcgtaactcgccttaccgaccgaaaccggccgggtaacccaacgttacgtaccgttaaccgccccgaaggttacccgtaggttccgaaggtttcgggacgtacggggttcggtacgggacggttaacgtacggttacttccggtcctaccgtacctacgtacncgtacgacgtaccgccgtacgtacgaacgttcgtaacggtacgtttacttttaacggttaacttaacgttttacctttagtttaccgaacgttccgttaaacgttaaccggttattaaccgttacggttacgttaccccggtttaccgttacgtttaccggttaccggtaacgggttaccgggtaaccgtacggttcggtaacggtacgtaaacgaaccggttaactacgggttagtccggttacccgtacgtacccgtacttaccgg

SEQ ID NO: 70017 - DNA, 755 bp, Homo sapiens
  misc_feature: GYAE6OF02I8YTF.51.76.G10.1.454.CMB.1.raw
  modified_base (137)..(137): a, c, t, g, unknown or other
  misc_feature (137)..(137): n is a, c, g, or t
  modified_base (194)..(194): a, c, t, g, unknown or other
  misc_feature (194)..(194): n is a, c, g, or t
  modified_base (207)..(207): a, c, t, g, unknown or other
  misc_feature (207)..(207): n is a, c, g, or t
  modified_base (566)..(566): a, c, t, g, unknown or other
  misc_feature (566)..(566): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagatacnctggagaagtagtgatgacgcagtctccagccaccctgtctgtgctccgagggaaangccacctctccgngcagggccagtcacgtagtgttacgacagtccgtaacttacgccgttggtaaccaggacaacgaaaccgtgggaccccagggtcccctccgaacgggtcctaccccgttcacgttcaagttcgaagtccgactaaccgtaccgaccgaaccggggtaccacgtagtaacttaccctcccaaggtacccagggttaccgtacgtcgggaccgaaggggtttcgggttcggaggggactaacggtaccgttactacgttcctacgaacctacgtacacgggacctacggtcccgtacgtccgtaaccggtcggttacgtaaacgtttagtttacgttaacgtttaaacttttaaccggttnttaccggtaccgtaacggtattaaaccggttattaaaccgttaccgtcccggtaacccgttacccgttaacccgttaggtttaccggaaccgggtacggtacccgaacgtccgggtaacggtaaccgtaaaccgtaaccgtaaacgtaccgttagggtaaccgtacggttccgacctccggttaaccgg

SEQ ID NO: 70018 - DNA, 790 bp, Homo sapiens
  misc_feature: GYAE6OF02FNKKU.51.76.G10.1.454.CMB.1.raw
  modified_base (208)..(208): a, c, t, g, unknown or other
  misc_feature (208)..(208): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaacgtagtgatgacgctagtcctccagccctacctgtcctgtcgtcctccgaagggggaacncgccctaccctctcctgcacgggccagtcagtagtgtagcagcgtacttagccctgtaccagacagaaccgtggaccacggcctaccccggaggacccttccctactacttaccttaagtcgacttcggacctaccgtaccccaacggaaccggggtccctaacgttaggtaccttacccgtacccgacgtacccgttaaggtttaccgaggggtttcggacggttagggtttcggggtacgtacggggaactacgggttaccgttaacctaccgttacctacccgtaaccgttaactaccggaacgtccgtaccggtccgtcgacgtacgttaccgttaagtaacgtttagtttacgtactttaacttttacgttactacgttacgacgtaagttaagttaactaaacgttaccggtaccggttaacccgttacccgtttaaccgttaccggtttaccgggaacccggttaggggaacccttacgggtacccggtaacgggtaaccgtaaccggtaaacccgtaaaaccggttacggtaccggttaccgggacccgtttacgtaccccgtacctttaccgg

SEQ ID NO: 70019 - DNA, 723 bp, Homo sapiens
  misc_feature: GYAE6OF02GXLXB.51.76.G10.1.454.CMB.1.raw
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
tcagcgatcgtatacacgaccggtgctcgatttagtcactcatacaggggaggaactgctcagttaggacccagacggaaccatggaagccccagcgcagcttctcttcctctgctactctggcctcccagactaccacgtggaagtaagtgtagatcgacgcgagtcctaccacgccacccgttgtcctgtcgtctaccggaaggggaaagacgaccctacccgtctccgtagcgacggccagtacgacgtaggttaggttagacgtagcgtacttacgcgttacggaccgagacaacgtaaccgcggacgacggcctccgacggccttccnctactctacgtgactcgacncctaccacggaccggtacactacgtataccgaccctaagccggtagttacgaggtcgtagcggttacgtcggtacgtacgagttacgtctactacactaacgcgtacagccgacgttcacggtacgtacgttaccggaagttaaccgttgggtttacctaaacttaaggtttacctattaaccggtacgtagaaccgtttaagtaacgtaacgttacccggaccgtttacccgtacgttttaaaccgttacccgggtagttaacccgggaccgggttaacccgtaagggtaaccgggtacgttaacgggtaaccttaaaccgaacggtttaccgtagggttcctaccgggtaccagttaccccgttacgg

SEQ ID NO: 70020 - DNA, 730 bp, Homo sapiens
  misc_feature: GYAE6OF02GHK4R.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccacccttctccgtgcgacgggccagtcaggtagtgttagcagcgacttagcctggtaccagaccaagaaccgtggccaggcctcccgaggtcctcctacacttacgtatcggattcggacctactacccgaacggaaccgggaccctaagtcgtaactaccgtaccccgaggtacccgtaggtttcgagggtcggtacgtaggggtttcgggacgtacggggactaaggttacctacctaccgtcctaccgacctacgtccgacgtcctaacggtcccgtagtaccgtacgttacggtaagtaacgttttgttttacgaacgttttaattttaccgtttacgtacggttaacgtacgtaacgttaaagttaaacttaaaccgtttacggttcccgttaacccgtttaaccgttaaccgttttaccggttacgggaacccgggtaacggtaccaacggttcgggaggtaactaacgtaaccggtaaacggttacgttagtacggtaccgtaccgtaccctacgttaacg

SEQ ID NO: 70021 - DNA, 632 bp, Homo sapiens
  misc_feature: GYAE6OF02IVONS.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgttagcagcgtacttagcctggtaccagcaagaaacctggccaggcctcccgaggcctcctcatctatgatgacactccaacgaacgggcccagtgaactactcccgagtccctaggttccaggtcggacgtaggttcgggtctgggaactaggtacgttccactccgtcacctatccagcacgtctgactagtctagtaagttagttttacgacttaaattttacgttaccgttgtaccgtaagtacgtaagtttaaactaacgttaacgtcggtaccctttaccggttaaccttaccgttttacgggacccggtacggggtaacctagggtacgtacgggtaacgtaacgtaaccgtaaacggttaacgtcggtaccgtacgtacgtaccgtaccgttaacg

SEQ ID NO: 70022 - DNA, 683 bp, Homo sapiens
  misc_feature: GYAE6OF02G1I95.51.76.G10.1.454.CMB.1.raw
  modified_base (199)..(199): a, c, t, g, unknown or other
  misc_feature (199)..(199): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagcccacctgtctgtcgtctccgaggggaaanacgccaccctctcctggccgacgggccagtccagtacgtgttagcagcgtactcgcctcggtaccagacagaacctggaccacggcctcccgagtcctccncatacctangtctcgactagaccaaccggacggccactagacttaccgacccgagcctacggttaccgaggtcggcgtacggttacggggtacgttaggggaactaggtacggttaccacccttaccgtaccgtaccgtagtaccgacgtaccgaaccgccgtacgtacgtacgtaccggtaagtaagttttactttacgttaatttaactttacgttacctacgtctagtacggttaattacgtaacgttaccgttaccggtaccgttacgttaccgtacggtttaccgaccgggtacggtaccgtacggtccggtaacgtaaccgtaaacgttaaccgtaacgtaccggttacggtacgtacgtaccgtaccgaccgtacg

SEQ ID NO: 70023 - DNA, 684 bp, Homo sapiens
  misc_feature: GYAE6OF02GFD0H.51.76.G10.1.454.CMB.1.raw
  modified_base (145)..(145): a, c, t, g, unknown or other
  misc_feature (145)..(145): n is a, c, g, or t
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (339)..(339): a, c, t, g, unknown or other
  misc_feature (339)..(339): n is a, c, g, or t
  modified_base (566)..(566): a, c, t, g, unknown or other
  misc_feature (566)..(566): n is a, c, g, or t
  modified_base (638)..(638): a, c, t, g, unknown or other
  misc_feature (638)..(638): n is a, c, g, or t
  modified_base (679)..(679): a, c, t, g, unknown or other
  misc_feature (679)..(679): n is a, c, g, or t
tcagcgatcgtatacacgaccggtgctcgatttagtcactcatacagggggaggaactgctcagttaggacccagacggaaccagtggaacgccccagcgcagcttctcttcctctgctactctgcctccagactaccactgganaagtntgatgacgctagtctccagcctacctgtctgtcgtctacgagggtaancgacctacccgtntcctggaccgaggccaggtacaaggtgttaggttacgcgaacgtcgtacgttacggccttaggtacccagtacaacgtaaccgtcggaccacggcctcccgagtcctccgtacagtctagtgacgttnaccgtactaccgaaggtaaccgggccacgtacgtaactaccgtacccaggtacccgtaaggttcgaacggggtctacgtagggtttcgggtacggttggaaacgttacgttaccggttacctaacgttcccgtaacacctagtacgaccgacgttacggccctagggtaactacggttgtaaccggttaagtttccgtttagtaacttttaagtttattaccgttanaccgtagtacttagttaaacgtacgttactacgtccgttaactacggttcgttacgcggacggacgttacgntacggataacggtacaacgtacgttcgacgtcgactaccgnttacg

SEQ ID NO: 70024 - DNA, 843 bp, Homo sapiens
  misc_feature: GYAE6OF02FVYTO.51.76.G10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccgagcccaccctgtctgtgtctaccgagggggaaanacgcccaaccctccttcccgtggaccaggggcccaaggtcagagttggttacgcgacggcgtacttacgaccgtaggtacccagacaacgtaaaccgtggaccagggccctacccgagggtcctacctacatcctaatgacttcgaccacgtaccccgaacggaaccgggccctaagtacgaacttacctaccccgaagtcccgtaacgggttactacggttacgggtaccgtagggtttcgggtacggtacggggtaacctaggttaaccggttacctaaaccttccgtaacccgaccgtaaccgttacaacggtaccgtacgtacccgtacggaccgttaacggtttacgttaacggttaaacggtttacgttttaaccggtaagttttaaacttttacgtttaacgtacggtttacccggtaacggtaaccgtttaaactaaaccttttaaaacgtaaccggttacccggtaccccgtttaaacccggtaaccgttttaaccggttttaacccggggaacccgtaaacgggggtaaccctaaagggtcccggttaagggaaccgtaaacggttaaccgtaaaaccggtaaccggttacggggttaccggtaaccggttacgttacccgtaaccgtacgg

SEQ ID NO: 70025 - DNA, 744 bp, Homo sapiens
  misc_feature: GYAE6OF02HC6H8.51.76.G10.1.454.CMB.1.raw
  modified_base (144)..(144): a, c, t, g, unknown or other
  misc_feature (144)..(144): n is a, c, g, or t
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (602)..(602): a, c, t, g, unknown or other
  misc_feature (602)..(602): n is a, c, g, or t
  modified_base (682)..(682): a, c, t, g, unknown or other
  misc_feature (682)..(682): n is a, c, g, or t
  modified_base (688)..(688): a, c, t, g, unknown or other
  misc_feature (688)..(688): n is a, c, g, or t
  modified_base (737)..(737): a, c, t, g, unknown or other
  misc_feature (737)..(737): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctccagataccactgganaagtgtgagtgacgnagtctcagtcccacctgttctggtcgtccgtacggaagggggaaancgaccctaccctcgtaccgtgccggacgggtcctagtcaaggtggttagttacgacgtcggacgtaccttaggtcccttagggtaaccagtactaaaccggaaaccgtcggaaccgcggccctaacccggnggtcccttaccnctactacgttaagtcggtaactcggaacctaccgtaacccgaaacgggacccggtacccgtaattacgtaaacctaccgtacccgtacggaccccgtttaggtaccggtaaggtcgggtaccgttaggggtttaaccgggtcggtaacggggaacctaaggttccgttaactaccgttctaccgacctagtaccgactacgccgtacgtctaacgtgtccgtaagtaccgtttattagtaacctttaagttttntaccgtacggtacagttaccttaaagtactaaacggttaccgtccggttacccttacgttaacttccggttacgaacggngtaacngtacggtacgagtaacctaacgagggttacacggtcgtacgtcaaccgnttcccgg

SEQ ID NO: 70026 - DNA, 834 bp, Homo sapiens
  misc_feature: GYAE6OF02HXG02.51.76.G10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtcactcatacaggggggaggaactgctcagttaggacccagacggaaccatgggaagccccagcgcagcttctcttcctcctgctactctggctcccagataccactggagaagtagtgatgacgcagtctccagccctacctgtctgtgtctcgaaggggaaancgccaccctctcctgaccgagggccagtacagtagtcgttacgcgacggccgtaagttacgccgttacggtaccgaaggcaaacgaaaccgttcggaccgaacggccctacccgtacggtccctacccgttcgtaacttacgttaacgtgtaacgtcggactaccttaccgaacggaaccgggtcctaacgtcgtaactaccgtaccccgacgtaccgtaaggttcggtaacggtacgggtcggttacgggttcgggtaccgggtacggggtaccgtaaggttaccggttaccgtaacccgttccgtaacccacgttaacgtaccccggaacggtacccgtaccggttccgtaacggtaccgtacggttacggtaacgttaaggtttacggtttacgttaaaccgttttaacgttttaacgtttacgtacgttaaccgtaagtaacgttaaattaacgttaaacgttaccggttaccggttaacccgtttaaccggttaacggtttaccggttaccgggttaacgggtaccgggttaacgtaacggtcggttaacgggtaaagttaaacccgtaacggtaaaaccggttcggtaacgggttacgtaccggtaacgtacccggaacctttaccgg

SEQ ID NO: 70027 - DNA, 557 bp, Homo sapiens
  misc_feature: GYAE6OF02HPXAY.51.76.G10.1.454.CMB.1.raw
  modified_base (195)..(195): a, c, t, g, unknown or other
  misc_feature (195)..(195): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttagcagcgacttagcctggtaccagcagaacctggccaggcctcccgaggcctcctcatctatgatgcatccacgaagggccactgactactcccagccgtaggttcagtggcaggttcgggtcgtagggacagtacggttcacctctaccacctatccgacgacacgctgctacgtctagtagttatttcgtactattttactagttagtacagtactatataagtacgtcgtaccttcgtacttacgtttcggacgtacgggacctaaggtcgtagggacgtacgtaccgaacggtacgtcggtaggtacgtacgacgtacgttacg

SEQ ID NO: 70028 - DNA, 833 bp, Homo sapiens
  misc_feature: GYAE6OF02GOO8Q.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatgacgcagtctccagccaccgtgtctgtcgtctaccgaggggaaagcgcccacccgttctccgtgccgagggcctagtacaggtacgtggttacgcgacgtacggtaacttacggcccgttaggtaaccctaggaccgtaaacggtaaaacccgttgggaacccgtacgggtacccctaccccggaggtccccttaccctacgtaacgttccgttaaacgtggtaacgttacggacctaacctaacccggaaacgggtaaccggggacccctaacgtagtaacttaccccgtacccgaacgtacccggttaaggttaccgacgggttcgggaacgtacggggttcgggttacggtacgggaacgtaacggttaccggttacctaccgttcctaacccaaccgttacgtaccgaacccggtccgtaaccgtcccgtcggtacccgtaggttaccggtaagtaacgttttacgtttaccgttaactttaagtttaccgtactacgtaccgacgtaacgttaacgttaacgttaaacgtaccgttacccggttaccttaccgtaacgtttaccgggtttaccggaccggtacggtacccgtagggtcgttaaggaccgtaacgtaaaccggtaacgttacggttacggtaccgtaaccggtacgtacccgtaacttaaccgg

SEQ ID NO: 70029 - DNA, 802 bp, Homo sapiens
  misc_feature: GYAE6OF02GXOGA.51.76.G10.1.454.CMB.1.raw
tcagcgatcgtatacacgaccggtgctcgatttagtcactcatacagggggaggaactgctcagttaggacccagacggaaccatggaagccccagcgcagcttctcttcctcctgcctactctggctcccagataccactggagaagtagtggactagaccgtcagtcctaccacgccctaccttggtactggtcgtcgtccggaaggggtaacacgccctacccgtctcccgtggaccgacggggaccctaaggttccaagggtacggtttacgttaacgacgacggtccgtaaccgtttacggcccgttaacgtaccgacggaccgaagtaaacccgtcggcccgtaacggtcccgtaccccggtacggtccccttcccgtactacgtaccttacgtcgtacggtcgactaccgtacccgacggaaccgggaccttaccgtagtaaccgtaccgtaccccgaggttacccggtacggtacggagggttcgaccggttaggttcggggtacgtacgggaacctaggttaccgtaccttacgtccgtacctaaccgtactaacacccggtacgtaccgtccgtacgtacgtacgttacgtaacggttaagtttacgtttactaaacgtttactttacgtttacgtacgtacgtactacgttaacggttactacttacggtaccgtaccttacgtaccggtttacgtacccgggtacggtacggtaccgtaggccgtaacggtacgtaaccgtacgtaacggttaacgtcgggtaaccaccgttaaccgccctaccgttacg

SEQ ID NO: 70030 - DNA, 765 bp, Homo sapiens
  misc_feature: GYAE6OF02HDCQN.51.76.G10.1.454.CMB.1.raw
tcagcgatcgtatacacgaccggtgctcgatttagtcactcatacagggggagggaactgctcagttaggacccagacggaaccatggaagccccagcgcagcttctcttcctctgctactctgctcccagataccactggagagtagtgatcgacgcgtagtcctccacgacccacccgttgtcgtgtcgttacctaccggaaggggaaactcgaccctaccctctcccgtggccgtacgggccaggtcgaagtacgttgttagcgtacggcgttaacttcgccgttagtaccaggtacaacgaaccgtcggacctacggcctacccgaggttccctaccttccgaattaccgtagcgtatcggacttacgaccgtaacggaccgtacacttacgattacccgaccgtggtcccgtaaggttcgaaggggtcgtacgtagggtttcggaggtaccggagtcggtacttccgattccctacactaacgcgtacgtccgtaacgtccgtacgtacgtacgtcgtaaacgtaacggtttagtttacgtaaacgtttaacgtttacgttaacttacgtacgtacgtaagttaaacgttaaacgttaacgtaccgggttacgttacccgttaaccgtttaaccgttaccgggtttaccgaccggggtacggtacccgttaaggtccggtaacggtaacggtaaccgttaaacgtaaccgggttacgttaccgggacgtttcccggtaaccgtaccgttaacccgttacg

SEQ ID NO: 70031 - DNA, 833 bp, Homo sapiens
  misc_feature: GYAE6OF02JFLWE.51.76.G10.1.454.CMB.1.raw
  modified_base (208)..(208): a, c, t, g, unknown or other
  misc_feature (208)..(208): n is a, c, g, or t
tcagcgatcgtatacacgaccggtgctcgatttagtcactcatacagggggaggaactgctcagttaggacccagacggaaccatggaacgccccagcgcagcttctcttcctcctgctactctggcctcccagactaccactgggaagaagtagtgatcgacgcagtctaccagcccaccctgtctgtcgtccacgaaggggaaacncgccacccgtctccgtggcgacgggcctagtacgaggtagttgttaacgcgaggtaccgtaccgttacgtcccggttaacggggtaacccaggacccaaaacggtaaaccccgtcggggaaccccgtaagggtcccttaccccgggaaggtcccttacccgttacaattccgtaagtcgacgtccgactactaccgaaacggtacggaccctacgtagtaacctcccgtaccgaacggtccgttacggtacgcggggtaggtacctagggggtttacggtacgacggggtaacgtagtaccccggttcaaccgtttccgaacccgaataccgtacgacggtacaccgttcgcgttaaccgaagttacggtaacggttaacgtttcgtttaaccgtaacttttaaacggttttactacgttacggtaacgttacgtaaaccgtaaagtttaaccgtaaaacttacccggttcggttaacccctttaaggttaaaccgttttccgttaacgggggtaaccccgaaggggttaaccccgtaaaggtcgggttaaaaccggtcggttaaacttaaacccgggtaagtccgtttacgggaccggttacgtaacccgtaccttagtaccgg

SEQ ID NO: 70032 - DNA, 657 bp, Homo sapiens
  misc_feature: GYAE6OF02GWSZH.51.76.G10.1.454.CMB.1.raw
  modified_base (194)..(194): a, c, t, g, unknown or other
  misc_feature (194)..(194): n is a, c, g, or t
  modified_base (458)..(458): a, c, t, g, unknown or other
  misc_feature (458)..(458): n is a, c, g, or t
tcagcgatcgtatacacgaccggtgctcgatttagtcactcatacagggggaggaactgctcagttaggacccagacggaaccatggaagccccagcgcagcttctcttcctctgctactctggctcccagataccactggagaagtagtgatgacgcagtctccagccaccctgtctgtgtctccaggggaangccaccctctcctgcagggccagtcagtagtgttagcagcgtacttagccttggtaccagccaagaacctggaccaggcctcccgaggcctccctcgacttacgtatacgtactcggccaacgttaccccaacggaacggggccctaacgtacggtaacttaaccgtccccgaagtccccgtaaggttccgtaagggttcggacgtacgggtttggggtccgtagggactaggtacgttccaccgttctaccaccgactcgacncgtacgcctcgacgtagttcgtagtagttctttacgtactttaacgttttattacgtagttcgagtacgttaagtactaacttaccggtacgttaccgttaccgttacttaccgtttacgaccgtacgggtactacggtcgtaggtaacgtacgtaaacgtacgtaacgttcggtacgtacgtaccgtacacgttaccg

SEQ ID NO: 70033 - DNA, 771 bp, Homo sapiens
  misc_feature: GYAE6OF02GE1YA.51.76.G10.1.454.CMB.1.raw
  modified_base (166)..(166): a, c, t, g, unknown or other
  misc_feature (166)..(166): n is a, c, g, or t
  modified_base (202)..(202): a, c, t, g, unknown or other
  misc_feature (202)..(202): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggaagtagtagtgatgacgcagtcnccagccaccgtgtctgtcgtctaccgaggggaaacncgacccaccgtctaccgtgacgtacgggtaccctagtcgaaggtacggttaggttacgacgaggtaccgttaacgttacggcccgttaggggtaacccaagggacctaaaaccgggtaaaacccgtcggggacccctagggtacccctacccggacggtacccttacccgttaactaacttaccgtaagtcggtaacgttacaccgtaaccgtacccgaaacgggtaaccgggccttaacggtacggtaacttaccgaccctacggaccgttacggttacacggtcggtacggtagggttcggtacggtacgggatacgtcgttacaccttcacgacctaatcgaagtcgaacgtcgttacggacctagggttataggtaactttggtttacaacgttttaacttattaacgcgttaagtacgattaaggtaacctataaccgttacgtaccttacgtacgttaaccgttccgaaccgggaacgggtcctaaggtacggtaagtaaccggtaacgttaaccgaacgggttacttacgggtaccgacttaccgggtaccctacgttccgg

SEQ ID NO: 70034 - DNA, 794 bp, Homo sapiens
  misc_feature: GYAE6OF02FZ3X4.51.76.G10.1.454.CMB.1.raw
  modified_base (274)..(274): a, c, t, g, unknown or other
  misc_feature (274)..(274): n is a, c, g, or t
  modified_base (631)..(631): a, c, t, g, unknown or other
  misc_feature (631)..(631): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgcagtctcacgccacctgtctgtgtcctacgagggaaatcgaccctacccgtctcctgcgtacgggccagtcaagacgttgtacgcagcgtaaccgttagcccttgggtaacccnggtaccgaagtaaaccgtcgggaccaacggcccctaccccggacggtcccgtccctacgtactacctagtcgtaacgtcgacctaactcccgaacgggtaccgacccgtacgtacgtactacccgtaccgacgttacccggtacggttaccgtaggttacggtacgttaggggtccggggttaccggtacggggtaacgtacggttaacgtttacccggaccttacccgtacccaaaccgttacgtacccgaaccgtaccggtcggtaaccccgtgaccgtttacgttaaccgtagttaaacgtttacgtttttaacgaactttttaaagttttaccgttacgttcgtaaaccgttntaaaaccgttaagttaccgttaaacgttccgttaccgtacccgtttaccgttacggttaaccgttccgggtaacggtaccggaacttaccggtaggtaccgtaacgaaaccggttaacaacccggttaggtcccgtaaccgttccacggttaccgtacctcgg

SEQ ID NO: 70035 - DNA, 861 bp, Homo sapiens
  misc_feature: GYAE6OF02FJFBS.51.76.G10.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (324)..(324): a, c, t, g, unknown or other
  misc_feature (324)..(324): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagactaccactggacgaagtagtgatgacgcagtctcagccacctgtctgtcgtcctcgaggggaancgccaccctcncctgccgacgggccagtcagtacgtgtacgcacgtcgaacttagccgtaggttacccagaccaacgtaaacccggttggacccgacggaccgttccccgacggtccctacccttnacgttacccttatggtaacttgacctaacgtaccgaacggtaaccgggccttacgtcggaaaccttcccttaccggaccgtaccgttaccgggttacgtacggggtacggacgttacggggttccgggtaacggtaccgggaacgttacgggttaaccgttacccgtaaccgttacccgttacaccccgtaagtccaacgggcccgttaaccggtccgtaacgggtactaccggttaaccgggttaggtaaaccggtttagtttaacgttaaacccttttaaagttttccgtttaaacgtacggttaccggttaaacggacgttaaacgtttaaaccggttaaacttaaacccgggtccggttttaaccccgttaaccgggtttaaacggttttaccccgggttttaacccgggccggggttaaacccgacccgggtttaaacggcgggtaacggtaaccgtttaaaccgtaaaccggtaaaccgggttaacgtccgggttaccggtaccggttaaccgtacccgtacgtttaaccg

SEQ ID NO: 70036 - DNA, 711 bp, Homo sapiens
  misc_feature: GYAE6OF02HAVFS.51.76.G10.1.454.CMB.1.raw
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctaccgaaggggaagacgcccacccttctcctgcagggccagtcagagtgtancagcgacttagctgaccngcacgaactggacaggctcccaggctacctcagtctatgatgctactccaagaacgggcctaagtgaacttacacccgagtcccgtaggttcacggtgacgtacgggttggtctaggggactaggtacgtttcaccgttctaccgacctatcgaacgcgtacgtccgtgaccgtacgtacgtacgtaaggttacgttttacaaccgtttaagttttaccttaccgttgttacctaacggttactaacggtttaacttaaaccgtttaacggtaccggtaccccgttttacccgttaaccgttttaaccgggtttacgggtaacccggtaacggggtaacccgtaacgggtacccggttttaaggggaacttaaaccggttaaaccggtaaaccggttaacggttaaccgggttccggggtaaccgttttacccgggaaacctttaacccgttaccgg

SEQ ID NO: 70037 - DNA, 685 bp, Homo sapiens
  misc_feature: GYAE6OF02FYI2P.51.76.G10.1.454.CMB.1.raw
  modified_base (560)..(560): a, c, t, g, unknown or other
  misc_feature (560)..(560): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaagacgtcccaaccctcttccctggccgaggggccccaaggtccaaggtaggttgttaagccaaggcgtaacttagcccttagggtaacccaaggtaccaaaggtaaaaccccgtggacccctaacgggcccttacccccgaaggtccttacccgtacaacttctaaactgagtcgacctaactccgaaacgacgggcctactaggaacttacgcccaaggtcccgtaaggttcaacggttcggactacggggttcggtacggtacgggaactaggtcgtttaccacttctaccactactcgaagccaagtcctagtccagttcgtagtaacgttatttcgaacttagtttatacgtagtccaanctaagttataacgttacgcggttacccttcgttacgtacgtttacggacccgtagggtaaccctaggtcggaggtactaacgtaaccggaacgttacgtgggtacgtccgtaggcctacggtaac

SEQ ID NO: 70038 - DNA, 597 bp, Homo sapiens
  misc_feature: GYAE6OF02G8I11.51.76.G10.1.454.CMB.1.raw
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaangcccacccttntcctgccagggccagtcagagttgtagcagctacttagcctgtaccagcaagaaacctggaccaggcctacccgaggctccgtacactcgtatggactcggacactaccgacgaacgggccatcgatactacccagccgtaggttcaggtcgccaggtcgggtcgtaggggactaggtacttacgacctcctacaaccctagtcgacgcacgtcctagcgtagtactaggaacttaagtttcgtaacttaatttacttacgttcgtacaagtacgtaagtttactaaacgtacgttacgaccttacgttactaccgtttcgaccgtacggaccaaggtcgtaggaacgtacgtaacaaacggtacttcggtacgtactacgtaccacgtc

SEQ ID NO: 70039 - DNA, 662 bp, Homo sapiens
  misc_feature: GYAE6OF02GHSRL.51.76.G10.1.454.CMB.1.raw
  modified_base (106)..(106): a, c, t, g, unknown or other
  misc_feature (106)..(106): n is a, c, g, or t
  modified_base (166)..(166): a, c, t, g, unknown or other
  misc_feature (166)..(166): n is a, c, g, or t
  modified_base (200)..(200): a, c, t, g, unknown or other
  misc_feature (200)..(200): n is a, c, g, or t
tcagcgatcgtatacacgaccggtgctcgatttagtcactcatacaggggaggaactgctcagttaggacccagacggaaccatggaacgccccagcgcagcttcncttcctctgctactctggcctcccagactaccactggacgaagtagtgatgacgcagtcnccagccacctgtctgtcgtctccgaaggggaaancgccacccttctcctgcacgggccagtcagacgtgtagcagcgacttacgcctggtaccagcaacgaaccgtggaccaggcctaccgaggtcctcccactacttccgtagtcgactcgactacgtaccgaacgaacgggcccagtcgaacttaccgccagtcccgtaggtttaccagggtgcagggtcggtcgaggactagtacgttacacgttacctcgaacctactacgacgtaccgacgtcctacgcctacgtacgtaacgtaagtttactttacgtaacgtttaactttaacttacgtacgtacgtaacgtacgtaaagttaacgttaacgtaaccgttcgtacccgttaccgtacgttacgtttaccggacccggtacgggtaccgtaacggtacgtacggaacgtaacgttaaccgaacgtacggtacggttaccgacgtaccgactaccgtaccg

SEQ ID NO: 70040 - DNA, 744 bp, Homo sapiens
  misc_feature: GYAE6OF02I2S1U.51.76.G10.1.454.CMB.1.raw
  modified_base (202)..(202): a, c, t, g, unknown or other
  misc_feature (202)..(202): n is a, c, g, or t
tcagcgatcgtatacacgaccggtgctcgatttagtcactcatacgagggggaggaactgctcagttaggacccagacggaaccatggaagccccagcgcagcttctcttcctcctgctactctggctcccagataccactggagaagtagtgtatgacgcagtctccacgcctaccctgtctgtgtctacgaggggaaacncgcccaccctctcgtgcgacggccagtcagtagttgttagcagcgtaacttacgccttacggtacgacgtacgaacgtaaacccgtggacccgacggtccctacccggacggtcctccgtactattcctaagtcgatccgacacctaccgaaggtaaccggcctacgtagtactaccgtcccaacggtccgtaggtttcgaacgggttcggtacggtagggttcgggtacggtacgggaaccgtagttacccgtacctacgttcctaaccgaccgtacgtacgtaacgcgtacgccttagtccgtaagttaccggttaagtaacggttttactttagtaaccgttttaagttttaaacgttcgttaaccggtacgttaacggacttaaaccggttaaattaaccgtttaccggaccggtttaccgttaacccgttaattaccgggttaaccgaccggtacggtaaaccggtagtacggtcggaaactacgtaaccgtaaaccggtagttccggtagaccgtacgtaccgtaaccgttaccgg

SEQ ID NO: 70041 - DNA, 763 bp, Homo sapiens
  misc_feature: GYAE6OF02GOOJH.51.76.G10.1.454.CMB.1.raw
  modified_base (145)..(145): a, c, t, g, unknown or other
  misc_feature (145)..(145): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
tcagcgatcgtatacacgaccggtgctcgatttagtcactcatacaggggggaggaactgctcagttaggacccagacggaaccatggaagccccagcgcagcttctcttcctcctgctactctggctcccagataccactgganaagtagtgatgacgcagtctccagcccacctgtctgtgtcnccgaaggggaaacncgaccaccctctaccngcacgggccagtcagtagtgttanctagcgtacttagccgttcggtaaccagaccgaacgtaaaccgtggaccacgggacctaccccgacggcttaccccgactaatccctaaagtcgtaagttacgactaacgtacccgtaaccgaaacggggaccctaacgtaacgtaacgttacgtaccccaagtacccgtaaggtttcgaacgggttcggacgtaagggttgggtacggtacggggtactacggtaacttcgactacgtaccaaccgtacgtaccgacggactacggtaccgtgtacgacgttacggtaacgtaaagtttacgttttacggttaactttaagtttttaaacgttacgttacggttaacgtaacggtagttaaacgttaaacgttaaacgtttaacgttacccggtaccggtttacccgttaattaaccgttttacggacccgggtaacgggtaccgtaaacggtcgttaaccgggtaataacgttaaccgaaaccgttacggtacggtcgttacggtacgtacctaccgtacg

SEQ ID NO: 70042 - DNA, 794 bp, Homo sapiens
  misc_feature: GYAE6OF02H71IO.51.76.G10.1.454.CMB.1.raw
  modified_base (755)..(755): a, c, t, g, unknown or other
  misc_feature (755)..(755): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccactggagaagtagtgatgacgcagtcctaccgacgcccacccgtgttctcgtcgttcctaccgaaggggaaacgaccgcccaccccgttctcctagccggacggcccagtccaaggtagttggttaacgcgacggaccgtacgttacgtaccgtcggtaccacgtaccaacgaaaccgtcggaccgaacggtcctacccgaggtccttccctacttactacgtactaggtactccggctaactccggaacgacgggtacctacgtagtaaccttaccgccgtacggccgtacggttacgagggttcggacgttacgggtgggtacggtacggtacggtaacgttcggttacccaccgttaccgtaccgaacccgtaacgttaccgacggccccgaactcccggtacgtacgttaccgtaggttaacggtaagtttctttaacgttaactttaacttttacggtacgttattaccggagtaacgtaaaggtttaaccttaagtttaacggtcccgttaacctttaacccgtacggtttaacggtttaccgggaccggtaacgggtaacccgtagggttccggtaagggtaacccgttaactaaccgttaaaaccgggngtttacccggaggtacccgtacctaccgtaacgttaccg

SEQ ID NO: 70043 - DNA, 917 bp, Homo sapiens
  misc_feature: GYAE6OF02GZT50.51.76.G10.1.454.CMB.1.raw
  modified_base (200)..(200): a, c, t, g, unknown or other
  misc_feature (200)..(200): n is a, c, g, or t
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagactaccactggagaagtagtgatggacgcagtctccagccaccctgtctgtgtctccgaaggggaaancgcccaccctctcctgcagggccagtcagngtgtagcagcgtactacgcgtcggtaccagaccaagaaccctggcccaggcctccccgaggcctacccgtntacttaccgtatcggtactacgacctactaccccgaaccgaacggggtaccctaacggtgaacgttacccacccggacgtacccggtaacggtttcgaagggttcggacgttacggggttcggggtacgttaacgggaacgtaacggttccgttaacccgtaccctttaccgtaaccccgtaactaccggttaacccgaaccggtacgtaacccgggtacccgtaccgggtaccgttaaccggttacggtaaacggttaaggtttaaccgttttttacggtaaaccgtttttaaactttttaaccggtttaacgtttacccggttaaccgttaaacgggtttaaaccttaaacggttttaaaaccgttttaaaaccgggttaacccgtttaacccgggtttaacccccgttttaaacccgggtttaacccgttttaaacccgggttttttccggggaaacccgggttaacccgggggttaaacccgttaacgggggtaacccggttaacgggttaaaccgtaaacccggtttaaaccggttaaaaacccgggttaaccgggtttcggttaaccggttaacccgggttacccggtaacccgttaacccgtttaccgg

SEQ ID NO: 70044 - DNA, 727 bp, Homo sapiens
  misc_feature: GYAE6OF02FW0M5.51.76.G10.1.454.CMB.1.raw
  modified_base (197)..(197): a, c, t, g, unknown or other
  misc_feature (197)..(197): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagactaccactggagaagtagtgatgacgcagtctccagcccacctgtctgtctctcgaagggaancgccaccctctccgtgcgacgggtcctagtcaggtagttgtacgcgagcgtacttgccttacggtaccagacaaggtaacccgtggacccgacggtccctaccccgaacggtcctccccgtacacttctacgtgtatcgacctactaccgacggaaccggcctacgtagtaactaccgtacccgacgtaccgtagttccgtagggtacggtcggacgggtttcgggtacggtacgggaacgtacggtaactttccgtaaccgttccgtaaccctacctcgtacgtacgaccgtacggtccgtacgtaccgtacggttaccgtaaggttactttacggttttaactacttttaaactttttacgttactttcgggtataacggttactaaggtttaacttacgtttaagtccccgttaccgttaccgttacgtttaccgttggaacccgggttacggtaccgtacgtacggtccggtaacgaactaaccggtaagtcgttacggtacggttacgtccgtacgtcttaaccg

SEQ ID NO: 70045 - DNA, 726 bp, Homo sapiens
  misc_feature: GYAE6OF02GLZAI.51.76.G10.1.454.CMB.1.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (521)..(521): a, c, t, g, unknown or other
  misc_feature (521)..(521): n is a, c, g, or t
tcagcgatcgtatacacgaccggtgctcgatttagtcactcatacagggggagaactgctcagttaggacccagacgaccatggaagccccagcgcagcttctcttcctcctgctactctggctcccagataccactggagaagtagtgatgacgctagtcctccagcccaccctgtctgtgtcctaccgagggaaancgcccacccgtctcctgcgacggccagtcagtggtgttagcagctacgtcgccgtcgtaccacgactaacgaaccgtcggcctacggtcctacccgngtccctccgtcagtacctgtcgtatcgactacgtcccgaaggaacggccagtcgaactccgtacccgacgacccgttaggtccgaggtcggacgtagggtcggttacgacgggactaacggttccgttaccaccgttaccgaacgtaccttacgtaccgtacggaacccgttcgtaccccgtaaggtaacccgttggttacccgttaagggtaactttacggtttntaaacgtttaccttttagttaccgtacgaacgtacggtaacttagttaaaacccgtaagttaaccgttcccgttaaaccttacccgttaacttttaccgggttacccgaccgtaaccgggtaacctgtacgggttaacgtacgtaaaccgttaaaccgaaggtttccgacggttaccggtaccgtacggtaccctaaccgttacg

SEQ ID NO: 70046 - DNA, 737 bp, Homo sapiens
  misc_feature: GYAE6OF02JCOPQ.51.76.G10.1.454.CMB.1.raw
  modified_base (480)..(480): a, c, t, g, unknown or other
  misc_feature (480)..(480): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (527)..(527): a, c, t, g, unknown or other
  misc_feature (527)..(527): n is a, c, g, or t
tcagcgatcgtatacacgaccggtgctcgatttagtcactcatacagggggaggaactgctcagttaggacccagacggaaccatggaagccccagcgcagcttctcttcctcctgctactctggcctcccagataccactggagaagtagtgatgacgcagtctccagccacctgtctgtgtactccgaaggggaagacgccctacctctccgtcgccgacgggccctagtaccagtacgtgttacgcgacgtacgtacttagccgttacggaccagactaacgaaccgtcggaccgacggcctaccccgacgggtccctcctaccgacttaccgtagtacgtaacgtcggactactaccgaccgtaacgggaccctacgtcggtaactccgaccctacggtccgtaacggttcaacggtcgtacgtacggtcggttcggacgttacagttactcgtactccgtaccacgactcgacgngtaccgcgtancgtancgtagtaacgttagtttcgactttaaagttnttaccgtacgacgtacgaccgttaagttaacgtaaccgttacgtcggtaaccccgttaacgttaccggttaaccggtttacccgggaccgttaaacggggacccctacgggttacggtttaaaccgggacttaaaacccgtacggttaaaaccggtaacgtttccggggaacggttccccggtaacgttacccggaccttttaacccggg

SEQ ID NO: 70047 - DNA, 899 bp, Homo sapiens
  misc_feature: GYAE6OF02H461Z.51.76.G10.1.454.CMB.1.raw
  modified_base (205)..(205): a, c, t, g, unknown or other
  misc_feature (205)..(205): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgggaagaagttagtgatgacgcagtcctccagcccaccctgtctgtctcctaccggaggggaaanacgcccaccctcctcctgcagggccagtcagtagtgttagcgtagcgtacttacgccgtaggtaccagcaacggaaacccgtcgggacccaggccctacccgaggtcccttcctacctattaccttatagtatcgacctacgtaccaacggaacggaccctaacgtagtaactaccgtacccgacgtccgttaaggtttccgaggttcgggacgtcgggtttcgggtacgtaggggaactacgggttacgttacctacgttccgttacccacccgtagttaacccgacggtaccgtaccggtacccgtcgaaaccggttacggttacgttaacggttaacgtttacgttttaacgttaacccgtttaaagtttttaaccgttaccgttaaaggtacccttaaagggtacccgttaaaacggtttaaactttaaaacccggggtttaacggttaccccgggtttaaccccgtttaacccgggttttaaacccggtttttaaaccggggtttttccgggggaaaacccccggttaaccggggggttaaaacccgtaacccggggtttaacggttaaccggggtaaaccggtttaaacccgttaaaacccgggtaaaaccggttaaacggggtttttaccggggtaacccggttacccggtaaccgtttaaaccccccgggtacctttttaaccggg

SEQ ID NO: 70048 - DNA, 721 bp, Homo sapiens
  misc_feature: GYAE6OF02F6OZW.51.76.G10.1.454.CMB.1.raw
  modified_base (160)..(160): a, c, t, g, unknown or other
  misc_feature (160)..(160): n is a, c, g, or t
  modified_base (202)..(202): a, c, t, g, unknown or other
  misc_feature (202)..(202): n is a, c, g, or t
  modified_base (268)..(268): a, c, t, g, unknown or other
  misc_feature (268)..(268): n is a, c, g, or t
tcagcgatcgtatacacgaccggtgctcgatttagtcactcatacaggggaggaactgctcagttaggacccagacggaaccatggaagccccagcgcagcttctcttcctcctgctactctggcctcccagactaccactggagaagtagtgatggacncagtcctcctagccaccctgtctgtcgtctcgaaggggaaancgccctaccctctcctggccgacgggccagtcagtcgtgtacgcacgctacgttgcctaggtaccngacaacgaaacctggacctacggcctacccgaggtccttccgtacgtacttcgtaacgtgtactcgacctacgtaccgtaacggaacgggtacctacgtaggaacttaccgtacccgacgtacccggtagttacgaggttcggacgtaggggtcggtacgtacgggactaggtacgttcgacctccgtaaccacctacgtcgacgtccgtacgtccgaacggtcctaacggttacgtaaacgttaagtttacgttttaccgtaaacgttttaacttttaacttcgtacgttaacgaacgttacgtaaacttaacgttaaacgtaccgttacggttaccccttaaacgtccgtttaacggtacgggtaacccgttacggaacgtacggtacgtacgggtaactaaccgtaaccggtaaattcggtcggtacgacgtaccgtaccgtcgttaacg

SEQ ID NO: 70049 - DNA, 757 bp, Homo sapiens
  misc_feature: GYAE6OF02F313L.51.76.G10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtcctcgaaggggaaancgcccaccctctcctgcgacgggccagtcagagtgtagcagcgtacttgcctggtaccagcagaaccgtggaccaggtcctccccgaggtccttcccgtactacgttaccttacgtggtaacgtcggaacctaaccttacccgaaaccggtaacccgggggtaccctaaaccggttacggtaaacctttaacccggtaccccgtaacggtaccccgtagggtttaccgaagggttccgggaccggttacggggtttcggggtacggttacggggaaactacgggttaccgtttaccgtaccgtttaccctaaccgtaacccgtacgttacccgaacggtacccgttaacggtcccggttacggaccgttaacggttcgttaacggtaacgtttaacgttttcggaacttttaaattttaacgttacgttcggtactaacggtacttaaaaggttactaaacgtaccgttacggccctttactacggttcgttaccgggacgtacgggacctagtcggtaagacgtactaacgaacgtctcgtacggctaccgctactcg

SEQ ID NO: 70050 - DNA, 909 bp, Homo sapiens
  misc_feature: GYAE6OF02FV587.51.76.G10.1.454.CMB.1.raw
  modified_base (606)..(606): a, c, t, g, unknown or other
  misc_feature (606)..(606): n is a, c, g, or t
tcagcgatcgtatacacgaccggtgctcgatttagtcactcatacagggggaggaactgctcagttagacccagacggaaccatggaagccccagcgcagcttctcttcctcctgctactctggctcccagataccactggacgaagtagtgatgacgactagtactccacgccctacccgtcgttactcgttgtaccgttcgaacggggtaaacgaacggaccctacccttaccgttaccgtgaccgtacgggacccacgttaccaagtacggtacggttaacgtacgaacgtaccgtaactttaacggggggtccttacgggtaaccgacgacctaacggtaaaccccgtacgggtacccgaacggccgtacccccgtacggtaccttaccctacgtaactaccttacgtagtacgtacgacccgtactacccgtaacggtaaccgggacccgtaacgttacgaaccttaaccgtaccccgtaaccggtcccgttaacggttcccgtaagggtacggtaccggttagggttacgggtaccgttagggaaccgtcgggtaaacgtttcccgtaaccgttacctaacctaacccgtaacgttaccnccggttacaccggtaccgttcgtacccgtaagttacggtaacctaaggttttaccgttttacgtaacctttaacgtttttagtaaaccccgtttcgtaaacccgaaggtacctttaaaaacgggttttactaaaaccggtttacggttcccgttaaacccgtttaccgttaaccggtttaggtaccgggtaccggggtaacggtaacccgttaaggtaccggtaaccggttaggtaacccgtaaacgtaaacccggtacgtttccgggaaccgttacgtaccccggtaaccttaccgttaccg

SEQ ID NO: 70051 - DNA, 836 bp, Homo sapiens
  misc_feature: GYAE6OF02IPGZH.51.76.G10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactggagagtagtgatgacgcagtctccagcctaccctgtctgtgtcctaccgaaggggaanacgcccaccctctcctagccgagggccaagtcaagtgtagttacgacgacgtcgtaacttaggcccgttaggtacccagacgtaacggtaaacccgtcggacccagggccccttaccccggacggtcccttaccccgtactaaccttccttaagtcggtaatcggtacctaacctcccaaacggaaccggggtccccaaggttagtaacccttactacccccgaacggtaccgtacggtttaccggagttacgggtacggtaggtttccgggttacggttaacggggacctaagggtacttttaccccacttcccgtaaccgaccctatacccggaaacgtctaaccggtcccgtacggtaccttacggtaccgtttaagtaaaccgttttaggttttaactacccggtttaaaattttttaccgttaacgtttaccgttaagtaacgttaaaccgttaaagtttaacttaaaccggttaccggtaacgttaccccgttttaccgtaaccgtttaaccgggtttcccgggaaccggttaaccggggaaccctaagggtaaccggttaacgggtaactacgtttaaacccggaaacgtacggttcgggttacccggaacctacggccttaaccgtacg

SEQ ID NO: 70052 - DNA, 792 bp, Homo sapiens
  misc_feature: GYAE6OF02GWDGX.51.76.G10.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagcgatcgtatacacgaccggtgctcgatttagtcactcatacagggggaggaactgctcagttaggacccagacggaaccatggaggccccagcgcagcttctcttcctcctgctactctggctcccagataccactggagaagtagtgatgacgcagtctccagccaccctgtctgtgtctccgaggggaagngccaccctctcctgcagggccagtcagngtgtagcagcgacttagcctggtaccagaccaaggtaaacccgtggacccaacgggtcctaccccgagggtccttccccgtcaacttccgtaacttaggaattcggacctaacttaccccgaaaccggtaaaccgggggccctaacgttacgtaacgttaccctacccccgaacggtaccccgtaacggttttaccgaacgggttaccgggtaccgtaggggtttaccgggggtacggttacgggggtaaccgtaaggttaccggtttaccgtaacccggttacccttacccaacccgttaccgtaccgaacgaccgttaacccgggtccttacggaccgttacggttaccgtaagggtaaagtttagttttacgacttttaaagttttactttaacgtcgtacgagttaccgtaagttaacttaaacgtaccgttcggtacccttaccgttaacgttaccggtttacggacccggtaggggaaccctaggtcggttacggaagtaaccgtaacccgtaaacggttacgttcggtaccggttaccgtacgtacccgtacccggttac

SEQ ID NO: 70053 - DNA, 804 bp, Homo sapiens
  misc_feature: GYAE6OF02HE2BM.51.76.G10.1.454.CMB.1.raw
  modified_base (144)..(144): a, c, t, g, unknown or other
  misc_feature (144)..(144): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagcgatcgtatacacgaccggtgctcgatttagtcactcatacagggggaggaactgctcagttaggacccagacggaaccatggaagccccagcgcagcttctcttcctcctgctactctggctcccagataccactgganagtagtgatgacgcagtctccagcccaccctgtctgtgtctccgaaggggaaacgngccaccctctcctgcagggccagtcagngtgtagcgagggacttaggcctggtaccagcagaaccgtggaccagcctccgaggtcctcctcattcctaagtgatcgactactaccgaacggacgggtcctacgtacgtaacttaccgacccctaggacccttagggttactaacgggttcgggacgtacgggttcggggtacgtagggaactagggtacgtttcaaccgttctaacccgacctacgtaccgaaccgtacctacgggtacctcggtaacccgttaacggttacgttaacgggtaaacgttttacctttaacgggttaaacctttttaaagttttttaaccgtttaaccgtttacgttaacggtaaacggtaacctttaaacgggttaaactttaaaaccggtttacccgtttaaccgggttaaccctttacccgggttttaaaccgttttaccggttttacccggggtaaacccgggttaacgggggaacccttaacggggtaccggttaacggggtaacgttaaccgggttaaaccgtaaaccggttaacgtttacgggtacgtaccgtacgtacccgtacttcgtttacccgg

SEQ ID NO: 70054 - DNA, 754 bp, Homo sapiens
  misc_feature: GYAE6OF02G62IZ.51.76.G10.1.454.CMB.1.raw
  modified_base (193)..(193): a, c, t, g, unknown or other
  misc_feature (193)..(193): n is a, c, g, or t
  modified_base (535)..(535): a, c, t, g, unknown or other
  misc_feature (535)..(535): n is a, c, g, or t
tcagcgatcgtatacacgaccggtgctcgatttagtcactcatacaggggaggaactgctcagttaggacccagacggaaccatggaagccccagcgcagcttctcttcctcctgctactctggctccagataccactggagaagtagtgatgacgcagtctccagccaccctgctgtcgtctcgaggggaanacgccacctctcctgacgagggccagtcagtagtagttagcagtcgacgttagccgtacggtaccagacaacggtaaaccgtcggacccgtacggaccctaccccgacgggtacccttaccccgtccgtaacttaccgttaacgtacggtacgttcggtacctaaccgttaccccgaaccggtaaccggggtacccctaacgttaggaacctttaacccgtaccccgacggtacccgtaggtttaccgagggtacgggaccgtaaggggttcgggtcggtaacgggaacgtacggttaacgttccgaccgttccgaccgtaacccaagttccgacggtaccncgtacgtcgacttacgttacggtataacggttagttttacgtacgtttaatttacgttaccgttagtcgtaacgttacgtaagtttaactaaacgttacggtaccgttaccgttacgttactaccggttcggacgtaccgggtaacacggttcgtacggaacgtaacgtaaccgtaacggtaccgttcgggtaacgaccgtacggtacctaccgttacg

SEQ ID NO: 70055 - DNA, 757 bp, Homo sapiens
  misc_feature: GYAE6OF02H5RR6.51.76.G10.1.454.CMB.1.raw
  modified_base (164)..(164): a, c, t, g, unknown or other
  misc_feature (164)..(164): n is a, c, g, or t
  modified_base (472)..(472): a, c, t, g, unknown or other
  misc_feature (472)..(472): n is a, c, g, or t
tcagcgatcgtatacacgaccggtgctcgatttagtcactcatacgaggggaggaactgctcagttaggacccagacggaaccatggaacgccccagcgcagcttctcttcctcctgctactctggctcccaagactaccacgtggagaagtagtgatgacgcngtctaccacgcccaccgtgtcctggttcgtaccgtaccggaagggaaacgtaccgcccctacccttccgtccgtacgccggaacgggcctacgtacgtaaggtgttacggttagaccgacggtacctacgttacgtccgttaggaccacgacgaacgtaacgtccggaccgacggtcctacccgcggcccttaccgtactacgtactgtacgtacgtcgactaccgtaccgacggaacgtaccacgtacgacttaccgacccgacgtcgtaacgttcgacggagtcgtcggtcggtacggacggaccngttaccttacgtacctctacctacgtactcgacgaccgtacgtacgtcgacgtacgtacggtagtagttaacgtttacgtactttaaacgtttcgtttacgtacggtaccgttacgtaaccgttaaattacgttaaaccgttaccggtacccgtttacccgtttacccgttaacggtttaccgttaaccgggaccgtaacggggtacgtaccggttacgtaacggtaacgtaccggttaaaccgacggttacggtcggtaccgaccgtacgtacccgtataccgg

SEQ ID NO: 70056 - DNA, 784 bp, Homo sapiens
  misc_feature: GYAE6OF02GX94A.51.76.G10.1.454.CMB.1.raw
  modified_base (340)..(340): a, c, t, g, unknown or other
  misc_feature (340)..(340): n is a, c, g, or t
tcagcgatcgtatacacgaccggtgctcgatttagtcactcatacagggggaggaactgctcagttaggaccagacggaaccatggaagccccagcgcagcttctcttcctcctgctactctggcctcccagactaccactggagaagtagtgatgacgcagtctccacgccacctgtctgtcgtctccgaagggaaagcgacccaccctctccgtgacgacgggcctagtcagtagtgtacgcgagcgtacttacgccgtaggtaaccagacaacggtaaaccgtcggaccacgggtccctacccgacgggtcctaccctctacttctaagtgaacgtncccgtataccgaacgggaccgggtcctaacggtgtaacctaccgtacccgtacggtaccggtaggttacgacggggttcggacggttacgggtcggggttccggtaaggggtaacctaggtttaccgtacctacccgttacctacccgaaccgttactacggaaccgtccgtacggtcccgttacggtctaaccgggttataaacgggttaacgtttttacgtttaacggtttaacctttaaatttttaacggttcgtttaacggtcccgttaaagaaccggtttaaacgtttaaacttaaccgttaaccggttcccgtaacccgtttacccgttacgtttaccggttaccgggaacccggtaacgggtacctaacgggtcaagggttaaccaacgtaaacccgtaacgtcggttacggtgaccttacggtaccgtaccgtacg

SEQ ID NO: 70057 - DNA, 393 bp, Homo sapiens
  misc_feature: GYAE6OF01BTTNI.49.26.C04.1.454.CMB.1.raw
  modified_base (390)..(393): a, c, t, g, unknown or other
  misc_feature (390)..(393): n is a, c, g, or t
tcagagtcgagagacacgaccggtgctcgatttagtctagcgactttgggtttgggagatgcattgccaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccacctcctctctctcgactctgagcggctggcaaggcgcatagnnnn

SEQ ID NO: 70058 - DNA, 527 bp, Homo sapiens
  misc_feature: GYAE6OF01AS3JV.49.26.C04.1.454.CMB.1.raw
  modified_base (237)..(237): a, c, t, g, unknown or other
  misc_feature (237)..(237): n is a, c, g, or t
tcagagtcgagagacacgaccggtgctcgatttagtctagcgactttgggtttgggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgaccaaaaaatntgcttgttggtaccagaagaagtcaggccaggccccggtgttgctcatctatgacgacagaaaacgaccctccgggatccctgagagattctctggctccacctcagggaccatggccacgttgactatcagcggggcccagggtggaggatgaaggtgactactattgttactcaccagacaccagtagaaatcacagaggaatattcggacggagggaccaagctagaccgtctaggtcagcccgaaggctcgccccctcggtccactctcgttcccacctcctctcc

SEQ ID NO: 70059 - DNA, 396 bp, Homo sapiens
  misc_feature: GYAE6OF01DXQ6E.49.26.C04.1.454.CMB.1.raw
  modified_base (387)..(387): a, c, t, g, unknown or other
  misc_feature (387)..(387): n is a, c, g, or t
  modified_base (393)..(396): a, c, t, g, unknown or other
  misc_feature (393)..(396): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcgggctggcaaggcncatagnnnn

SEQ ID NO: 70060 - DNA, 395 bp, Homo sapiens
  misc_feature: GYAE6OF01D2E6E.49.26.C04.1.454.CMB.1.raw
  modified_base (392)..(395): a, c, t, g, unknown or other
  misc_feature (392)..(395): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcggctggcaaggcgcatagnnnn

SEQ ID NO: 70061 - DNA, 398 bp, Homo sapiens
  misc_feature: GYAE6OF01CXQCD.49.26.C04.1.454.CMB.1.raw
  modified_base (394)..(398): a, c, t, g, unknown or other
  misc_feature (394)..(398): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctcgttcccgcctcctctctctcgactctgacgcggctggcaaggcgcatagnnnnn

SEQ ID NO: 70062 - DNA, 529 bp, Homo sapiens
  misc_feature: GYAE6OF01BR31D.49.26.C04.1.454.CMB.1.raw
  modified_base (239)..(239): a, c, t, g, unknown or other
  misc_feature (239)..(239): n is a, c, g, or t
  modified_base (420)..(420): a, c, t, g, unknown or other
  misc_feature (420)..(420): n is a, c, g, or t
  modified_base (434)..(434): a, c, t, g, unknown or other
  misc_feature (434)..(434): n is a, c, g, or t
  modified_base (441)..(441): a, c, t, g, unknown or other
  misc_feature (441)..(441): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggcccggtgttgctcatctatgacgacagaaaacgccctcgggatccctgagagattctctggcctcacctcgagggaccatcggcctacgttgaactatcgaggccggggcccagggtcggagggatggaaggtgactactattgttacncacagacacagtanaaatcanagagaatatcggacggaggacaagctagaccgtctagtcagcccgaaggctcgcccctcggtcaccttctcgttcccaccctctctcc

SEQ ID NO: 70063 - DNA, 521 bp, Homo sapiens
  misc_feature: GYAE6OF01D4BEA.49.26.C04.1.454.CMB.1.raw
tcagagtcgagagacacgaccggtgctcgatttagtctagcgactttgggtttgggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgccctcgggatccctgagagattctctggctccacctcagggaccatggccacgttgactatcagcggggcccagggtgaggatgaaggtgactactattgtactcaccagacaccagtagaaatcacagaggaatattcggcggaggaccaagctagaccgtctaggtcagcccgaaggctcgccccctggtcactctcgttcccaccctcctctcc

SEQ ID NO: 70064 - DNA, 424 bp, Homo sapiens
  misc_feature: GYAE6OF01DP1C1.49.26.C04.1.454.CMB.1.raw
  modified_base (398)..(424): a, c, t, g, unknown or other
  misc_feature (398)..(424): n is a, c, g, or t
tcagagtcgagagacacgaccggtgctcgatttagtctagcgactttgggtttgggggagatgcattgccaaaaaatatgcttgttggtaccagaagaagtcaggccaggccccggtgttgctcatctatgacgacagaaaacgaccctccgggatccctggagagattcgtctggctccacctcagggaccaatggccacgttgactatcagcggggccaggtggaagatgaaggtgactactattgttactcaccagacaccgaagtgaaaatcacagaaggaatagttcggacggagggaccaagctgaccgtccaggtcagcccaaggctgcccctggtcactctcgttcccgcctctctctctcgactctgagcggctggcaaggcgcatagnnnnnnnnnnnnnnnnnnnnnnnnnnn

SEQ ID NO: 70065 - DNA, 509 bp, Homo sapiens
  misc_feature: GYAE6OF01EHNBX.49.26.C04.1.454.CMB.1.raw
  modified_base (236)..(236): a, c, t, g, unknown or other
  misc_feature (236)..(236): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgccaaaccgntatgcttattggtaccagcagaagccgggccaggcccctgtgttggtgatgtataaagacacgtgagaggccctcgagggactccctggagcgattctctggctccgaggtcagggacaacggtcacgattggccatcagtggagtccgaggcagaggacgaggctagactattatgtcaatcaacagacactattgtacttatgtcttcgaactgacgacagtccacgtctggtcagcccagcccaacccactcacactctcgtcccgtccc

SEQ ID NO: 70066 - DNA, 173 bp, Homo sapiens
  misc_feature: GYAE6OF01C72GH.49.26.C04.1.454.CMB.1.raw
  modified_base (173)..(173): a, c, t, g, unknown or other
  misc_feature (173)..(173): n is a, c, g, or t
tcagagtcgagagacacgaccggtgctcgatttagtctagcgactttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 70067 - DNA, 779 bp, Homo sapiens
  misc_feature: GYAE6OF01CM3SJ.49.26.C04.1.454.CMB.1.raw
  modified_base (367)..(367): a, c, t, g, unknown or other
  misc_feature (367)..(367): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtgtcggtgtccccaggacaaacggccaggataacctgctctggagatgcattgaccaaaaaaatatgcttgttggaccaagaagaagtacgaggacgacggacccggtcggttgtctcatctatgacgacaagaaacgaacccgtaccggacgtacctgacgagtatctactgcctcacctacacggacacnggccacgtcgactatacacggccggggtaccgacgggtgggtacgggaagtacgggtaagggtacggtaacttaacggttaattttacgggttaaccttaacccaaccgaacggtaacccgaaacctaacgggttaacggtaaaaaacttaaccgaacgaaacgggtaaggggtaaactttaaacgggtttccggggggaaacccggggaaggggggtaaaccccaaaacgggtacccgttacggggtaaacccccggttaaccggttaaccggggttacccgaaccggtaccccccggaaaacggggtcccttaccccggtcccccccggttaccccgggttaccgttacccctttaccccgttaacccgggtttccccccctaaccccgttcccccttacgtttcccccg

SEQ ID NO: 70068 - DNA, 397 bp, Homo sapiens
  misc_feature: GYAE6OF01A6GQD.49.26.C04.1.454.CMB.1.raw
  modified_base (373)..(373): a, c, t, g, unknown or other
  misc_feature (373)..(373): n is a, c, g, or t
  modified_base (394)..(397): a, c, t, g, unknown or other
  misc_feature (394)..(397): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctcgttcccaccctcctctctctcgactctgngcggctggcaaggcgcatagnnnn

SEQ ID NO: 70069 - DNA, 424 bp, Homo sapiens
  misc_feature: GYAE6OF01B338D.49.26.C04.1.454.CMB.1.raw
  modified_base (398)..(424): a, c, t, g, unknown or other
  misc_feature (398)..(424): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggcctccacctcaagggaccatggccacgttgactatccagcggggcccaggtggaggatgaaggtgactactattgttactcaccagacaccagtgaaaatcacagaggaatattcggcggagggaccaaggctgaccgtctaggtcagcccaaggctgcccctggcactctgttcccaccctcctcgtctctcgactctgacgcgggctggcaaggcgcatagnnnnnnnnnnnnnnnnnnnnnnnnnnn

SEQ ID NO: 70070 - DNA, 398 bp, Homo sapiens
  misc_feature: GYAE6OF01AZMHL.49.26.C04.1.454.CMB.1.raw
  modified_base (395)..(398): a, c, t, g, unknown or other
  misc_feature (395)..(398): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccgccctcctctctctcgactctgagcggctggcaaggcgcatagnnnn

SEQ ID NO: 70071 - DNA, 472 bp, Homo sapiens
  misc_feature: GYAE6OF01AHG0B.49.26.C04.1.454.CMB.1.raw
  modified_base (420)..(420): a, c, t, g, unknown or other
  misc_feature (420)..(420): n is a, c, g, or t
  modified_base (426)..(427): a, c, t, g, unknown or other
  misc_feature (426)..(427): n is a, c, g, or t
  modified_base (429)..(472): a, c, t, g, unknown or other
  misc_feature (429)..(472): n is a, c, g, or t
tcagagtcgagagacacgaccggtgctcgatttagtctagcgacttttggggtttgggggagatgcagtttcgccaaaaaaatatgtacttggttggtacccagaagaagtcaggccaggccccggtgttgctcagtctatgacgacagaaaacggaccctccgggatccctgagacgattctctggctccgacctcagggaccatggccacgttgactatcgagccggggcccaggtcggaggatggaaggtgactacgtattgtactacaccagacaccagtagaaaatcacagaaggaatatcggacggaggaccaaggctcgacctctagtcagcccaaggcctacgccccctaggtccacgttctcgttcccgaccctccgtctctctcgactcgtgagcggctggcaaggcganagtagnngnnnnnnnnnnnnnnnnnnnnnnnnnnnnnnnnnnnnnnnnnnnn

SEQ ID NO: 70072 - DNA, 540 bp, Homo sapiens
  misc_feature: GYAE6OF01ATK2U.49.26.C04.1.454.CMB.1.raw
  modified_base (240)..(240): a, c, t, g, unknown or other
  misc_feature (240)..(240): n is a, c, g, or t
  modified_base (415)..(415): a, c, t, g, unknown or other
  misc_feature (415)..(415): n is a, c, g, or t
  modified_base (437)..(437): a, c, t, g, unknown or other
  misc_feature (437)..(437): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgttggtaccagaagaagtcaggccaggcccggtgttgctcatctatgacgacagaaaacgccctcgggatccctgagagattctctggctccacctcagggaccagtcggccacgttgactatcaggcggggcccagggtggaggatggaaggtgactactattgttacncaccagacacagtagaaatcanagagaatagttcggacggaggaccaagcgtacgaccgtcaggtccaggcccggaggtctcggccccctcggtccacgtcctcgttccccacccttcctcctcc

SEQ ID NO: 70073 - DNA, 534 bp, Homo sapiens
  misc_feature: GYAE6OF01BQU5A.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatntgcttgttggtaccagaagaagtcaggccaggccccggtgttgctcatctatgacgacagaaaacgaccctccggggatccctgagagattctctggctccacctcagggaccatggccacgttgactatcagcggggcccaggtggaggatgaaggtgactactattgtactcaccagacaccagtgaaatcacagaggaatattcggcggtagggaccaagctgaccgtcctaggtcagcccgaaggctcggccccctcggtccactctcgttccccgcccttccgtcctcc

SEQ ID NO: 70074 - DNA, 539 bp, Homo sapiens
  misc_feature: GYAE6OF01AH8X9.49.26.C04.1.454.CMB.1.raw
  modified_base (508)..(508): a, c, t, g, unknown or other
  misc_feature (508)..(508): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaatgggatggtggtatcacctactatgcagactctgtgaagggtcgattcacatctccagagacaacagacaagaaacctccctagtactctagacaaatgaacagtctacgagaggtgacggacaccgtccttctactacgtgtcgacaaaagtcttaacgggnaccctactaccttattttcgaccctcgtcgg

SEQ ID NO: 70075 - DNA, 558 bp, Homo sapiens
  misc_feature: GYAE6OF01ATBKA.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtcccccaggacaaacggccaggataacctgctctggagatgcattgaccaaaaaaatntgcttgttggtaccagaagaagtcaggccaggccccggtgttgctcatctatgacgacagaaaaccgaccctccgggatccctgagagattctctggctccacctcacgggaccatggccacgttgactatcaggcggggcccagggtggaggatggaaggtgactatattgttactcaccagacaccagtagaaatcaacagaagaatagttcggacggaggaccaagcgtagaccgtcctaggtcagaccccgaaggcctccggcccccctcgggtcccaccgttcctcgtttccccaccccttccctctaccc

SEQ ID NO: 70076 - DNA, 393 bp, Homo sapiens
  misc_feature: GYAE6OF01EL5VU.49.26.C04.1.454.CMB.1.raw
  modified_base (392)..(393): a, c, t, g, unknown or other
  misc_feature (392)..(393): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccaccctctctctctcgactctgagcggctggcaaggcgcatagnn

SEQ ID NO: 70077 - DNA, 396 bp, Homo sapiens
  misc_feature: GYAE6OF01A806I.49.26.C04.1.454.CMB.1.raw
  modified_base (393)..(396): a, c, t, g, unknown or other
  misc_feature (393)..(396): n is a, c, g, or t
tcagagtcgagagacacgaccggtgctcgatttagtctagcgactttgggtttgggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggaggaccaagctgaccgtcctaggtcagcccaaggccaaccccactgtcactctgttcccaccctcctctctctcgactctgagcgggctggcaaggcgcatagnnnn

SEQ ID NO: 70078 - DNA, 656 bp, Homo sapiens
  misc_feature: GYAE6OF01AFK87.49.26.C04.1.454.CMB.1.raw
  modified_base (248)..(248): a, c, t, g, unknown or other
  misc_feature (248)..(248): n is a, c, g, or t
  modified_base (636)..(636): a, c, t, g, unknown or other
  misc_feature (636)..(636): n is a, c, g, or t
tcagagtcgagagacacgaccggtgctcgatttagtctagcgactttgggtttggggtgggcgtccaggaggcacgagctcctgggaatctcaccatggccgtggacccctctcctcgctccccctcctcactttctgcacacgtctctgaggcctcctagtgagctgacacagccaccctcggtgtcggtgtccccaggacaaacggccaggataacctgctctggagatgcattgaccaaaaaatntgctttgttggtaccagaagaagtcaggccaggccccggtgttgctcatctatgacgacaagaaaaccgaccctccgggactcccgtgagagattctctggcctccacctcgacgggaccagtcggcctacggtttcgaacttactcgacgggccgggggcccagggtgggaagggagtagggaagggtgaacttacgttagtttgttacctcaaccacgaaccaccgagtagaaactcaacgaaggaaggtaattacgttcgggacgggtaacgggaaccgaaggtaccgtacggaacccgttccgtagggtaccacggaccccgaacgggtcccgtcccggtccccccgttcgggtaccctaccgttcccgttcccgttacccccnccccttcccgtccttccccg

SEQ ID NO: 70079 - DNA, 396 bp, Homo sapiens
  misc_feature: GYAE6OF01E35YE.49.26.C04.1.454.CMB.1.raw
  modified_base (394)..(396): a, c, t, g, unknown or other
  misc_feature (394)..(396): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttccccaccctcctctctctcgactctgagcggctggcaaggcgcatagnnn

SEQ ID NO: 70080 - DNA, 576 bp, Homo sapiens
  misc_feature: GYAE6OF01ATNJC.49.26.C04.1.454.CMB.1.raw
  modified_base (257)..(257): a, c, t, g, unknown or other
  misc_feature (257)..(257): n is a, c, g, or t
  modified_base (340)..(340): a, c, t, g, unknown or other
  misc_feature (340)..(340): n is a, c, g, or t
  modified_base (383)..(383): a, c, t, g, unknown or other
  misc_feature (383)..(383): n is a, c, g, or t
  modified_base (517)..(517): a, c, t, g, unknown or other
  misc_feature (517)..(517): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcgtggtttcgtgtaggctatttaaaggtgtcagtgtgaagtgcagttggtggaatcgtgggggagtcgtggtagagccgtggggggtccctgagctctcctgtgcngcctctggattcatctttgatgattatgccatgcacgtggatccgtcaagccgtaccgggggaggtcgtgggagtggtctctnttagttaagttgggatggtggtatctacctatatgcagctcgngtgtaaggtcattcacctatcctacagaacgacaacaggcaacgtaacctccctagtatcctagaactaagtcgtaaactcgtctacgtagggagttcggaacggcctaacccgtcttacgtactacgttgganaacccgtaaagtccgttacggcaaccctaactaccttaatttccgaaccgtctaccggg

SEQ ID NO: 70081 - DNA, 434 bp, Homo sapiens
  misc_feature: GYAE6OF01C325A.49.26.C04.1.454.CMB.1.raw
  modified_base (429)..(434): a, c, t, g, unknown or other
  misc_feature (429)..(434): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaagtgactactattgttactacaccacgacaccagtagaaataacacagaggaagtaattacggtcggagggaaccgaacgactgacggtccctaggtcgagcccaacggacgtgcccctcccggtccgactcctcgttccctaccctaccccttctcctctcgacctcttcgagcgggcgtcggcaaggacgcgatagnnnnnn

SEQ ID NO: 70082 - DNA, 394 bp, Homo sapiens
  misc_feature: GYAE6OF01DULQ4.49.26.C04.1.454.CMB.1.raw
  modified_base (392)..(394): a, c, t, g, unknown or other
  misc_feature (392)..(394): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcaacagaggaatattcggcggaggaccaagctgaccgtcctaggtcagcccaaggctgccccctggtcactctgttcccacctcctctctctcgactctgagcggctggcaaggcgcatagnnn

SEQ ID NO: 70083 - DNA, 525 bp, Homo sapiens
  misc_feature: GYAE6OF01EX1EJ.49.26.C04.1.454.CMB.1.raw
  modified_base (490)..(490): a, c, t, g, unknown or other
  misc_feature (490)..(490): n is a, c, g, or t
  modified_base (497)..(497): a, c, t, g, unknown or other
  misc_feature (497)..(497): n is a, c, g, or t
  modified_base (519)..(519): a, c, t, g, unknown or other
  misc_feature (519)..(519): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaagggtctgggagtgggtctctcttattaattgggatggtggtatcacctactatgcagactctgtgaagggtcgattcaccatctccagagacaacagcagaaactccctgtatctgacaaatgaacagtctcagaggtgaggacaccgccttctactactgtgacaaaagnttacggngaccacaccttattttcgaccncgtcgg

SEQ ID NO: 70084 - DNA, 529 bp, Homo sapiens
  misc_feature: GYAE6OF01AV4TH.49.26.C04.1.454.CMB.1.raw
  modified_base (454)..(454): a, c, t, g, unknown or other
  misc_feature (454)..(454): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatcggccacgttgactatcagcggggcccagggtggaggatgaaggtgactactattgttactcaccagacaccagtagaaatcacagaggaatagtcggnggtagggaccaagctagaccgtcctaggtcagcccgaggctcgcccctgtccnctctcgttcccncctcctctcc

SEQ ID NO: 70085 - DNA, 419 bp, Homo sapiens
  misc_feature: GYAE6OF01A6PA4.49.26.C04.1.454.CMB.1.raw
  modified_base (389)..(389): a, c, t, g, unknown or other
  misc_feature (389)..(389): n is a, c, g, or t
  modified_base (396)..(399): a, c, t, g, unknown or other
  misc_feature (396)..(399): n is a, c, g, or t
  modified_base (401)..(402): a, c, t, g, unknown or other
  misc_feature (401)..(402): n is a, c, g, or t
  modified_base (404)..(419): a, c, t, g, unknown or other
  misc_feature (404)..(419): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacggaccctccgggatccctgagagattctctggctccacctcacgggaccatcggcccacgttgactatcagcggggcccaggtggaggatgaaggtgactactattcgttactcaccagacaccagtgaaaatcacagaggaatagttcggcggaggaccaagctgaccgtctaggtcagccaaggctgcccctggtcactctcgttcccacctcctctctctcgactctgagcggctggcaggcncatagcnnnncnncnnnnnnnnnnnnnnnn

SEQ ID NO: 70086 - DNA, 613 bp, Homo sapiens
  misc_feature: GYAE6OF01ALTNC.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtgtccccaggacaaacggccaggataacctgctctggagatgcattgaaccaaaaaatntgcttgttggtaccagaagaagtcaggccaggcccggtgttgctcatctatgacgacaagaaaccgaccctcgggactcccgtagagagtattctcgtggcctccacctcgacgggaccagtcggacctacggttcgacttagtcgagggccggggacccaggggtggaagggtacgtaggtaaggtgtactacgttagtttacgttactctaaccgagaaccacgtaagtagaaactcaacgaaggaagtaatacggttcggacgggacgggtaaccagtcgtacggaccgtacgtaggtccacggacccgacggtccgtcgccccgtacgggtcctaccgttcgtccgttcccgtcccttcccgtctcccg

SEQ ID NO: 70087 - DNA, 740 bp, Homo sapiens
  misc_feature: GYAE6OF01DQJ50.49.26.C04.1.454.CMB.1.raw
tcagagtcgagagacacgaccggtgctcgatttagtctagcgactttgggttgggggagatggcattggccaaaaaatatgcttgttgggtaaccagaagaagtcaggcccagggcccccggtgttcgctccacctcctatgtacgacagaaacgaccctccggatcccgtgacgtacgattctctcggctccacctcacgggaccagtggccacgtttgaccctagtcaacggcggggacccaggtcggaacggatgacggtgactactattgttactacgaacagactacctagtgaaactgacagacggaatagtccggaggacggactaagcgtacgtaccgtccgtaggtacgacggacccgaaggtccgtccgacccccgtcggtaccgtactcctacgtcccgtacctccgttcctctccgtccgtaccgtacgtcggtacggacgggtacgagggtaccgaaacgggtccttacggaaccttagggacctaggccggtcgagccgggtaaagcgtagacgtacgtacgtacgtacgtacgtacgtacgtacgacgtacgtaacgtacgtacgtacgtacgtacgtacggtaacgggtaccgggtacgggtacgggtaaccggtaaccggttaaccggttaccggcggttaccggtaccggtaacccggtaccggtacccggttacccggttacccggttaccccggtacccgtacccgttacccgttacccg

SEQ ID NO: 70088 - DNA, 689 bp, Homo sapiens
  misc_feature: GYAE6OF01B5ZX0.49.26.C04.1.454.CMB.1.raw
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
  modified_base (214)..(214): a, c, t, g, unknown or other
  misc_feature (214)..(214): n is a, c, g, or t
tcagagtcgagagacacgaccggtgctcgatttagtctagcgactttgggtttggggctctgggaaaggagccccagccctgagattcccaggtgtttccattcggtgatcagcactgaacacagaactcaccatggagtttgggctgagcggtcgttcgtctaaggcgtacttaaagtgcagtgtgagtgcngtgtgatgtgggngtgtgngngcgtcggtcgtgcgacgtctctgtgcgacgcgtcgtagtacgtactacttcgttagtatagtatagtcgtacgtagtcgtacgtacgtagtacgtaccgtacgtacgtacggtacgggtacggtacggtaggtacggtcggttcgttacgttacgttagttagttaggtacggttaggtacgttacgtaccgtaactacgtacgtacgtacgtacgtacgtacgtaggtacggtaacggtacgtactacctaccgtacgtacgtacgtaacgtaacgaacgaacgaacgacgtaacgtaaccgttaccgttacgtacgtacgtacgtaacgtaagtacgtaacgtacgtacgtacgtagtacgtacggtacgtaccgtaccgttacgttacgtaccgtacgtacgtaacgtaacgtaacgtacgttacgtaccgtaaccgtacgttaccgttacgttacgtaccgtaccgtaccg

SEQ ID NO: 70089 - DNA, 646 bp, Homo sapiens
  misc_feature: GYAE6OF01B8894.49.26.C04.1.454.CMB.1.raw
  modified_base (243)..(243): a, c, t, g, unknown or other
  misc_feature (243)..(243): n is a, c, g, or t
tcagagtcgagagacacgaccggtgctcgatttagtctagcgactttgggtttggggtggggctcaggaggcagacgctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgtggtaccagaagaagtcaggccaggcccggtgttgctcatctatgacgacagaaacgccctcgggatccctgagagattctctcggctccacctcagggaccatggacccagttcgactatcgaggccgggggcccaggggtcggagggacgtaggaaagggttgaccgttaactagtttagttaccgtaccaacccgtagaacctaacccgagtacgaaaactctaacgaagaaggtaaatacggtttacgggacgggtacgggaaccaaggtacgtacggacccggttaccgtacggtaccgacggtacccgaaacgggtccctaccccggtcccgttaccgtaccctaccgttcccgttcccctaaccccgtccccttcccgttccgttacccg

SEQ ID NO: 70090 - DNA, 399 bp, Homo sapiens
  misc_feature: GYAE6OF01CBHYE.49.26.C04.1.454.CMB.1.raw
  modified_base (388)..(388): a, c, t, g, unknown or other
  misc_feature (388)..(388): n is a, c, g, or t
  modified_base (394)..(399): a, c, t, g, unknown or other
  misc_feature (394)..(399): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctcgttcccacctcctctctctcgactctgagcggctggcaggcncatagnnnnnn

SEQ ID NO: 70091 - DNA, 407 bp, Homo sapiens
  misc_feature: GYAE6OF01DLFFF.49.26.C04.1.454.CMB.1.raw
  modified_base (399)..(407): a, c, t, g, unknown or other
  misc_feature (399)..(407): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgtactcaccagacaccagtgaaatcacagaggaatattcggacggagggaccaagctgaccgtcctaggtcacgcccaaggctcgcccctcggtcactctcgttcccgcctcctctctctcgactctgaggcggctggcgtaaggcgcatagcnnnnnnnnn

SEQ ID NO: 70092 - DNA, 515 bp, Homo sapiens
  misc_feature: GYAE6OF01DGBH9.49.26.C04.1.454.CMB.1.raw
  modified_base (241)..(241): a, c, t, g, unknown or other
  misc_feature (241)..(241): n is a, c, g, or t
  modified_base (462)..(462): a, c, t, g, unknown or other
  misc_feature (462)..(462): n is a, c, g, or t
  modified_base (484)..(484): a, c, t, g, unknown or other
  misc_feature (484)..(484): n is a, c, g, or t
  modified_base (506)..(506): a, c, t, g, unknown or other
  misc_feature (506)..(506): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgtggtaccagaagagtcaggccaggccccggtgttgctcatctatgacgacagaaaaccgcctcgggatccctgagagattctctggcctccacctcagggaccagtcggccacgttgactatcgaggccggggccagggtggaggatggaaggtgactatattgtactcaccagacaccagtagaaatcacagagaatagtcggcgaggacagcngaccgtcaggtcagccgaagcncgcccctgtcactctcgtcccncctctctcc

SEQ ID NO: 70093 - DNA, 404 bp, Homo sapiens
  misc_feature: GYAE6OF01CC3OE.49.26.C04.1.454.CMB.1.raw
  modified_base (302)..(302): a, c, t, g, unknown or other
  misc_feature (302)..(302): n is a, c, g, or t
  modified_base (399)..(404): a, c, t, g, unknown or other
  misc_feature (399)..(404): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagntgaccgtctaggtcagcccaaggcctgccccctggtcactctcgttccccgcctcctctctctccgactcgtgagcgggctcgcgaaggcgcatagnnnnnn

SEQ ID NO: 70094 - DNA, 521 bp, Homo sapiens
  misc_feature: GYAE6OF01BUVRA.49.26.C04.1.454.CMB.1.raw
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagcgtccggggaaggtctggagtgggtctctcttataatgggatggtgtatcacctatatgcagactctgtgaagggtcattcacatctcagagacaacagcagaactccctgtactctagacaaatgaacagtctacagaggtgaggacaccgcttactactactgtgacaaagtnttaacggtnacccactaccttatttcgacctcgtcgg

SEQ ID NO: 70095 - DNA, 406 bp, Homo sapiens
  misc_feature: GYAE6OF01CJ7V6.49.26.C04.1.454.CMB.1.raw
  modified_base (394)..(406): a, c, t, g, unknown or other
  misc_feature (394)..(406): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggaggaccaagctgaccgtctaggtcagcccaaggctacgccccctggtcactctgttccccacctcctctctctcgactctgacgcggctgcaaggcacatagnnnnnnnnnnnnn

SEQ ID NO: 70096 - DNA, 587 bp, Homo sapiens
  misc_feature: GYAE6OF01DQ0L0.49.26.C04.1.454.CMB.1.raw
  modified_base (266)..(266): a, c, t, g, unknown or other
  misc_feature (266)..(266): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
tcagagtcgagagacacgaccggtgctcgatttagtctagcgactttgggtttgggggctctgggaaaggagccccagtccctgagattcccaggtgtttccgattcggtgatcagcactgaacacagaactcaccatggagtttgggctgagcttgggttttccttgttgcttattttaaaaggtgtccagtgtgaagtgcagttggtggaatcgtgggggagtcgtggtagagccgtggggggtccctgagactctcctgtgcngcctctggattcattcttttgatgattatgccatgcactggactccgtanaacgcgtccgggggaagggtctgggagtgggtctntcttattagtggatggtgtatcactactatgcagactctgtaggaagggtctattccacacttcaccgagagaacaacagcaactaaacctcccttagtactactgaacaaagttcaaactcgtactacgaggtaggtgacggaccctaccgtcctttaccacttacgtgtacgaaagtaaaaggtcgtttaaacggcaaaccctactaacctttagtttaccgactccgtacggg

SEQ ID NO: 70097 - DNA, 532 bp, Homo sapiens
  misc_feature: GYAE6OF01DVNIP.49.26.C04.1.454.CMB.1.raw
  modified_base (241)..(241): a, c, t, g, unknown or other
  misc_feature (241)..(241): n is a, c, g, or t
  modified_base (363)..(363): a, c, t, g, unknown or other
  misc_feature (363)..(363): n is a, c, g, or t
  modified_base (468)..(468): a, c, t, g, unknown or other
  misc_feature (468)..(468): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctcgggatccctgagagattctctggctccacctcagggaccatggccagttnactatcagcggggcccagggtggaggatggaggtgactactattgttactcaccagacaccagtagaaaatcaacagaagaatagtcgggaggagggaccaagcncgaccgtcgaggtcaggcccaaggctcgccccctcggtccactctcgttcccaccctcctctcc

SEQ ID NO: 70098 - DNA, 629 bp, Homo sapiens
  misc_feature: GYAE6OF01DZ9US.49.26.C04.1.454.CMB.1.raw
  modified_base (227)..(227): a, c, t, g, unknown or other
  misc_feature (227)..(227): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctatttaaaggtgtccagtgtgagtgcagttggtggaatcgtgggggagtcgtggtagngccgtggggggtccctggagactctcctgtgcagcctctggattcattctttgatgattatgccatgcactgggatccgtcaacggcgtaccgggggaaggtctggggagttgggtctcttcttaagtttaagttgggattcgggtgtactcgaccttatatcgctagtactcgttggtaggtaagggttctaactttccaaccctatccgtacccgaagaacgaaccaagagaccaacgtaaaccttcccgtaagtactccgtagaactaaagtgaaactagtacctagaggaggttagaacgacctaacccgtcttacctaactacgtcgtacgaactaaaaggtcgttacgggtaccaaccctacttaaccgtttattttcgaacccgtgtacccgggg

SEQ ID NO: 70099 - DNA, 676 bp, Homo sapiens
  misc_feature: GYAE6OF01CU3N5.49.26.C04.1.454.CMB.1.raw
  modified_base (357)..(357): a, c, t, g, unknown or other
  misc_feature (357)..(357): n is a, c, g, or t
  modified_base (608)..(608): a, c, t, g, unknown or other
  misc_feature (608)..(608): n is a, c, g, or t
  modified_base (618)..(618): a, c, t, g, unknown or other
  misc_feature (618)..(618): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgcttaattttaaaaggtgtccagtgtgaagtgcagttggtggaatcgtggggagtcgtggtagagccggtgggggtccctgagactctccgtgtcgcacgcctctggtattctattctttgattgtattatcgccatcgactacgtcggtactccgtacgaacggtccggtccggggaaggtgtagggnggttcgggttcttcgttactttaagttaagttgggtagttgggtcgttaacttacctaaccttactagttcgacgtaagtactcgtggtaagggtaaacggtcgtaactttcccgaacctattccgaccgaagaacgaaccaaacgagaccaaacgtaacctaccgtagttactcgtaagaactaaatacgaaactagttcctagaaggtaggtacgaacggacctaacccgttcttaccgtacttaacgngtaacgaaanaaacgttacgttaccggaccgaacctaaccttaacttacttaccgactcggtacccgg

SEQ ID NO: 70100 - DNA, 674 bp, Homo sapiens
  misc_feature: GYAE6OF01C2WDZ.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaacaaaaaatntgcttgtgtacagaagaagtcaggccaggcccggtgtgctcatctatgacgacaagaaaaccgcccgtaccgggactcccgtagagagtacttctcgtcggcctccacctacgacgggaccagtcggacctacgttcgactagtacgacgggccggggacccgtaggggtcgggaagggacgtagggaagggtcgtaacttaacgttaatttacgttacctacgaaccaacggacaaccgtaagtaagaaaactcaacgaagaaggtaattaacggttcgggacgggaacgggaacccgtaaggccgtacggaacccgttaccgtacgggtaccacggtaccccgaacgggtccctcccggtccccccgttcgggtaccctaacccgttcccgttacccgttaccccctaccccctttcccgtcctttaccccg

SEQ ID NO: 70101 - DNA, 410 bp, Homo sapiens
  misc_feature: GYAE6OF01EU3R2.49.26.C04.1.454.CMB.1.raw
  modified_base (238)..(238): a, c, t, g, unknown or other
  misc_feature (238)..(238): n is a, c, g, or t
  modified_base (398)..(398): a, c, t, g, unknown or other
  misc_feature (398)..(398): n is a, c, g, or t
  modified_base (403)..(410): a, c, t, g, unknown or other
  misc_feature (403)..(410): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacagaaaacgaccctccgggatccctgagagattctctggcctccacctcagggaccatcggccagttgactatcaggccggggccaggtggagatgaaggtnactactattgtactcaccagaccacagtagaaatcacagagaatattcggcggagggaccaagctcgaccgtcgtaggtcacgcccaaggcctcgcccccgtacgtctacctctcgtcccaccctcctcctctctcgactctgacgcggctggcaaggcncatgnnnnnnnn

SEQ ID NO: 70102 - DNA, 684 bp, Homo sapiens
  misc_feature: GYAE6OF01ANUQT.49.26.C04.1.454.CMB.1.raw
  modified_base (243)..(243): a, c, t, g, unknown or other
  misc_feature (243)..(243): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagcttgacacagccaccctcggtgtcggtgtccccaggacaaacggccaggataacctgctcgtggagatgcattgaccaaaaaaatntgacttgttggtaccagaagaagtcaggccaggcccgtgttgctcatctatgacgacagaaaacgcccgtcggatccctgagagattctctggctccacctcgaggaccagtcgactacgttgacttatccgaggtccggggacccagggttgggaacgggatgggtaaacggtgaaccggttattaacgtttaggttaacctaccaacccgagtaacctaacccgaagttaaagaaaaacttcgaaccgaaaggtaacgggtaaacttaaggttacccgggaacgggtaacgggtaacccgaaaggtccgtacgggtaacccgttaccgtaagggttaccaacggtaccccgaaacgggtcccgtccggtacccccccgttccggtcttaacccgtccgtttaccggttccccccggtcccgttaccctccgtttccccg

SEQ ID NO: 70103 - DNA, 557 bp, Homo sapiens
  misc_feature: GYAE6OF01CTBBJ.49.26.C04.1.454.CMB.1.raw
  modified_base (241)..(241): a, c, t, g, unknown or other
  misc_feature (241)..(241): n is a, c, g, or t
  modified_base (333)..(333): a, c, t, g, unknown or other
  misc_feature (333)..(333): n is a, c, g, or t
  modified_base (480)..(480): a, c, t, g, unknown or other
  misc_feature (480)..(480): n is a, c, g, or t
  modified_base (533)..(533): a, c, t, g, unknown or other
  misc_feature (533)..(533): n is a, c, g, or t
  modified_base (544)..(544): a, c, t, g, unknown or other
  misc_feature (544)..(544): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgtggtaccagaagaagtcaggccaggcccggtgttgctcatctatgacgacaagaaacgaccctccgggatccctgagagtattctntggcctccacctcagggaccagtcggccacgttgactatcgaggccgggggcccagggtcggagggagtagaagggtgactactatttgttactcaccagacacagtagaaatcaacagaagaatagttcggacggaggacgaagcnggaccgtcgtacggcacggacccgaggcctcgcccccgtcggtccaccgttcnccgttaccccnccctcctcttccc

SEQ ID NO: 70104 - DNA, 413 bp, Homo sapiens
  misc_feature: GYAE6OF01CBYZN.49.26.C04.1.454.CMB.1.raw
  modified_base (404)..(413): a, c, t, g, unknown or other
  misc_feature (404)..(413): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacaagaaaacgaccctccgggatccctgagagattctctggctccacctcagggaccatggccacgttgactatcagcggggcccaggtggaggatgaaggtgactactattgtactcaccagacaccagtagaaatcacagagaatatcggcggagggaccaagctgaccgtcctaggtcacgcccaagggcctcgccccctcggtcactctcgttcccgccctcctctctctccgactctcgagccggcgtggcaaggcgcatacgnnnnnnnnnn

SEQ ID NO: 70105 - DNA, 398 bp, Homo sapiens
  misc_feature: GYAE6OF01BV1L6.49.26.C04.1.454.CMB.1.raw
  modified_base (388)..(388): a, c, t, g, unknown or other
  misc_feature (388)..(388): n is a, c, g, or t
  modified_base (394)..(398): a, c, t, g, unknown or other
  misc_feature (394)..(398): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggaggaccaagctgaccgtcctaggtcagcccaaggctgccccctggtcactctgttcccaccctcctctctctcgactctgacgcggctggcaaggcncatagnnnnn

SEQ ID NO: 70106 - DNA, 748 bp, Homo sapiens
  misc_feature: GYAE6OF01A85EG.49.26.C04.1.454.CMB.1.raw
  modified_base (241)..(241): a, c, t, g, unknown or other
  misc_feature (241)..(241): n is a, c, g, or t
  modified_base (332)..(332): a, c, t, g, unknown or other
  misc_feature (332)..(332): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggcccgtgttgctcatctatgacgacagaaaaccgccctaccgggatccctgagagattcncgtggctccacctcgacgggaaccagtcggacctacgtttcggaactacgtcgaacggccggggcccgaaggggtgggaacgggtagtagggaaacgggtagtacgttaacttagtttaggttaaccttaccgaaccgtaacgaaccgtaacccgtaaggtaacggaaaaacttcgaaacctaagggtaaagggtaaacgttaacggtttaccggggaaccggggtaaacggggtaaacccgaaagtacccggtacgggtaaaccccgttccggtaaagggttcccgaaccggtaacccccggaaacgggtaccccgtacccgggtccccccccgttaccggggttaccctacccgttacccggtttaccccggtttccccccggtccccccgtttacccgtcccgtttccccccg

SEQ ID NO: 70107 - DNA, 728 bp, Homo sapiens
  misc_feature: GYAE6OF01C2XXH.49.26.C04.1.454.CMB.1.raw
  modified_base (317)..(317): a, c, t, g, unknown or other
  misc_feature (317)..(317): n is a, c, g, or t
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccacctttggtgttgctgagctgggtttccttgttgctatttaaaggtagtccagtgtgaagtgcagttggtggaatctggggaggtcgtggtagagccgtgggggtcccgtgagacgtctcctcgtgcagcctcctggattctatctttgatgtattatgccntgcacgtgatccgtcagcgtccggggaagggtctggaggtgggtctctcttatttaagtgggtatggtgtacgtactacccgtaatacgtgacacgtacttaccgtgttaggaaaggggttcacgtttccaaaccctataccttcccgaagacggtaaaccaacgacggacctaaacgtaaaacccttccccgtttaagggtacttacccgttaacgaaccgtaaaagtaccggtaaaacgtacgttaccgtaccggttaaacgggaagggtttggggtaaaccggggaacccctaaaccccgttccccggttttttaaccctaaaccgtttaccccggttagttaccggtaaaccgttaaaaaaaggttacgttttaacccgggtaaccggtaaccccttaaaacccccg

SEQ ID NO: 70108 - DNA, 561 bp, Homo sapiens
  misc_feature: GYAE6OF01EU4XH.49.26.C04.1.454.CMB.1.raw
  modified_base (475)..(475): a, c, t, g, unknown or other
  misc_feature (475)..(475): n is a, c, g, or t
  modified_base (550)..(550): a, c, t, g, unknown or other
  misc_feature (550)..(550): n is a, c, g, or t
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatctgggggagtcgtggtagagccgtggggggtccctgagactctcctgtgcagcctctggattcatctttgatgattatgccatgcactggatccgtcaagcgtccggggaaggtctgggagtgggtctctcttataagttggatggtggtatcacctactatgcagactctgtagaagggtcattcaccatctccagagacaacagcaagaaacctccctagtactctgactaaagtcgaaacngtctacgagaggtgaacggaccacccggtccttacgtactacgtagtacgaaccgaaaagtactttaaccgggtnaaccctaaccg

SEQ ID NO: 70109 - DNA, 658 bp, Homo sapiens
  misc_feature: GYAE6OF01CKQIO.49.26.C04.1.454.CMB.1.raw
  modified_base (240)..(240): a, c, t, g, unknown or other
  misc_feature (240)..(240): n is a, c, g, or t
  modified_base (281)..(281): a, c, t, g, unknown or other
  misc_feature (281)..(281): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagcccaccctcggtgtcggtgtccccaggacaaacggccaggataacctgctctggagatgcatgaccaaaaaatntgcttgtggtaccagaagagtcaggcaggcccgtgttgctnatctatgacgacaagaaaccgccgtcggactcccgtagagagattctctggcctccacctcgagggaccagtcggccacgtgactactcgacggtccggggaccagggtcggagggataggaagggtgtaaccttaagttagtttacggttaactaccgtaaccacgaaaccaccgtaaagtaacgtaaaactcgaaacgaagggaacggtaaagttaacggttccgggaacggggtaacgggaacccaaaggtccgtacggaaccccggttcgtaacggcctaaacggcccgaaacggcccgttacccggccccccgtacgggtcctacccgttcccgttacccggttaccccaacccccttcctcgttacccccg

SEQ ID NO: 70110 - DNA, 539 bp, Homo sapiens
  misc_feature: GYAE6OF01EUKQM.49.26.C04.1.454.CMB.1.raw
  modified_base (243)..(243): a, c, t, g, unknown or other
  misc_feature (243)..(243): n is a, c, g, or t
  modified_base (494)..(494): a, c, t, g, unknown or other
  misc_feature (494)..(494): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaaatntgcttgttggtaccagaagaagtcaggccaggccccggtgttgctcatctatgacgacagaaaacgccctcgggatccctgagagattctctggctccacctcagggaccatcggccacgttgactatcgagcggggcccagggtggaggatgaaggtgactatattgttactcaccagacaccagtagaaatcaacagagaatatcggacggagggacaagctagaccgtctaggtccagcccaaggccncgccccctcggtccacctcctcgttccccacccgttcctcctccc

SEQ ID NO: 70111 - DNA, 402 bp, Homo sapiens
  misc_feature: GYAE6OF01D4EM5.49.26.C04.1.454.CMB.1.raw
  modified_base (395)..(402): a, c, t, g, unknown or other
  misc_feature (395)..(402): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggccaggtggagatgaaggtgactactattgttactcaccagacaccagtagaaaatcacagagaatatcggcggaggaccaagctgaccgtctaggtcacgcccaaggctcgcccctcggtcactctcgtcccaccctccactctctcactctgacgcggctcggcaaggcgacatagnnnnnnnn

SEQ ID NO: 70112 - DNA, 548 bp, Homo sapiens
  misc_feature: GYAE6OF01EF4F6.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgccctcgggactccctgagagattctctggctccacctcgagggaccatcggccacgttgactatcgagcggggccaggtggagagtgaaggtgactactattgtactcaccagacacagtagaaatcaacagagaatagtcggacggtaggaccaagctacgaccgtcgtaggtcacgcccgaaggctccgcccccgtacggtccacctcgttaccgttccccgccccttcccgtctcccg

SEQ ID NO: 70113 - DNA, 405 bp, Homo sapiens
  misc_feature: GYAE6OF01DQMXW.49.26.C04.1.454.CMB.1.raw
  modified_base (394)..(394): a, c, t, g, unknown or other
  misc_feature (394)..(394): n is a, c, g, or t
  modified_base (399)..(405): a, c, t, g, unknown or other
  misc_feature (399)..(405): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggccaggtggaggatgaaggtgactactattgttactcaccagacaccagtagaaaatcacagaggaatagttcggcggagggaccaaggctagaccgtcctaggtcaggcccaaggctcgccccctggtcactctgttcccgcctcctctctccgactctgagcggctggcaaggcganatagnnnnnnn

SEQ ID NO: 70114 - DNA, 402 bp, Homo sapiens
  misc_feature: GYAE6OF01CX0LN.49.26.C04.1.454.CMB.1.raw
  modified_base (389)..(389): a, c, t, g, unknown or other
  misc_feature (389)..(389): n is a, c, g, or t
  modified_base (395)..(402): a, c, t, g, unknown or other
  misc_feature (395)..(402): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacaagaaaacgacccctccgggatccctgagagattctctggctccacctcagggaccatggccacgttgactatcagcggggcccaggtggagatgaaggtgactactattgttactcaccagacaccagtagaaaatcacagaagaatattcggcggaggaccaagctgaccgtcctaggtcagcccaaggctcgccccctgtcactctcgtcccacctcctctctctcgactctgagcgggctggcaaggcncatagnnnnnnnn

SEQ ID NO: 70115 - DNA, 532 bp, Homo sapiens
  misc_feature: GYAE6OF01DPY6P.49.26.C04.1.454.CMB.1.raw
  modified_base (241)..(241): a, c, t, g, unknown or other
  misc_feature (241)..(241): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
  modified_base (499)..(499): a, c, t, g, unknown or other
  misc_feature (499)..(499): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacaagaaaacgccctccgggactccctgagagattctctggcctccacctcgacgggaccagtcggcctacgttgactatcgaggccggggcccagggtggaggagtggaaggtgactatattgtactcaccagacacagtanaaatcacagagaatagtcggnggaggaccagctcgaccgtcgtagtcacgccgaaggcncgcccctggtcnctctcgtcccncctcctctcc

SEQ ID NO: 70116 - DNA, 407 bp, Homo sapiens
  misc_feature: GYAE6OF01DJ8D0.49.26.C04.1.454.CMB.1.raw
  modified_base (396)..(407): a, c, t, g, unknown or other
  misc_feature (396)..(407): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgtttgactatcaggcggggcccaggtggaggatgaaggtgactactatgttactcaccagacaccagtagaaaatcacagaggaatagttcggcggagggaccaagctgaccgtctaggtcagccaggctcgcccctcgtcactctcgttcccacctcctcgtctctcgactctgacgcggctggcaaggcgcatagnnnnnnnnnnnn

SEQ ID NO: 70117 - DNA, 624 bp, Homo sapiens
  misc_feature: GYAE6OF01AKIK6.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatatgcttgttgtaccagaagaagtcaggccaggccccggtgttgctcatctatgacgacaagaaaaccgacccgtcgggactcccgtgagagtattctctcggctcccacctcgacgggaccagtcggcctacgttgaactatcgacgggccggggcccgtagggtcggaggagtaggaaggtgacttacgttattacgttactccacgacgactaccgtagtacgaaactcaacgaggaaggtaaatacggttacgggacgggtaacgggaaccaaggacgtacgtaccgtaccgtacggaccgtacgacccgtaacggccctaccggcccccgtacggtcccacgttcccgtaccggttccccctcccttcccgtccttccccg

SEQ ID NO: 70118 - DNA, 599 bp, Homo sapiens
  misc_feature: GYAE6OF01AD0UR.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatctgggggagtcgtggtagagcctggggggtccctgagactctcctgtgcagcctctggattcattctttgatgattatgccatgcactggatccgtcaagcgtccggggaaggtcgtgggagtgggtctctcttaattaagtgggtatggtggtatcacctactatgcagtactcgtggtaggaacgggtcattccacctatcctaccagacgacaaacgagaccaacgtaacctcccgtagtactccgtagacctaaagtcgaaactgtacctacgaggtagggtacgaacggaccctacccggttccctttactaccttacgtggtacgaaacgtaaaagtacgtttaccggacgaaccctaaccg

SEQ ID NO: 70119 - DNA, 693 bp, Homo sapiens
  misc_feature: GYAE6OF01ELO0S.49.26.C04.1.454.CMB.1.raw
  modified_base (246)..(246): a, c, t, g, unknown or other
  misc_feature (246)..(246): n is a, c, g, or t
  modified_base (328)..(328): a, c, t, g, unknown or other
  misc_feature (328)..(328): n is a, c, g, or t
tcagagtcgagagacacgaccggtgctcgatttagtctagcgactttgggtttgggggtgggctcaggaggcagagctctgggaatctcaccatggcctggaccctctcctcgctcccctcctcactttctgcacagtctctgaggcctcctagtcgagctgacacagccaccctcggtcgtcggtgtccccaggacaaacggccaggactaacctgctctggacgatgcagttgaccaaaaaatntgcttgttcgacagaagaagtcaggcaggcccggtgtgcgtcatctatcgacgacaacgaaaacgccctacgggactcccgngagagtacttcgtctcggcctcccaccgtcgacgggtaccagtcggcctacgttcgacttatcgacggtccggggaccctagggtcgggaaggtacgtacgggtaacggtcgtaacgttacgttaagtttacggttaacctaccgaaccgtacggtaacctaaccgtagtaaacgaaacttacgaacgaaggtaaggtaaacgttacggttaccgggaacggggaacgggtaaccgaaggtccgtacggaacccgttacgtacggttaccgaacggtcccggaaacggttcctacccggtcccccggttacggtaccgtaaccgttcccgttaccgttccccctaacccttccgtccgttacccg

SEQ ID NO: 70120 - DNA, 576 bp, Homo sapiens
  misc_feature: GYAE6OF01C6WYL.49.26.C04.1.454.CMB.1.raw
  modified_base (243)..(243): a, c, t, g, unknown or other
  misc_feature (243)..(243): n is a, c, g, or t
  modified_base (393)..(393): a, c, t, g, unknown or other
  misc_feature (393)..(393): n is a, c, g, or t
  modified_base (462)..(462): a, c, t, g, unknown or other
  misc_feature (462)..(462): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaaccaaaaaaatntgtcttgttggtaccagaaagaagtcaggccacgggccccggttgttgctcatctatgacgacaagaaaaccgcccgtcgggactcccgtaggagagtattctcgtcggcctccacctcgaacgggaccagtcggcctacgttgactacncgacgggccggggccagggtggaggagtaggaaggtgtactactagttcgtactacacagacacagtanaaatcacagagaataggtcggagggacggacagcgtcgaccgtcgtagcgacgaccgacgtcctccgccccgtcgtcctaccgtccgttacccgttccccgccctcctcctccg

SEQ ID NO: 70121 - DNA, 713 bp, Homo sapiens
  misc_feature: GYAE6OF01C29UD.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtgtcggtgtccccaggacaaacggccaggataacctgctctggagatgcattgaaccaaaaaatntgcttgtgtaccagaagaagttagacgacggacccggtgttgcgtcatctagtgacgaacaagaaaaccgacccgtaccggacgtcccgtagtagagtacttctcgtacggctcccacgtacgacggaccgactcggacctacgttacgactatccgacggccgggccgtaggtcgggaggagtagtaagggacgttactacgttagttgtttaacctaccgaacctaacggaaccaacccgtaaggtaaacgtaaactaccacgtaagggaagtaacgttaagttaccggggtaaccgggtaagggaacccgtaacggccgttaacggaccccggttaaccgtaacgggttcccgaacccgttacccggaaaccggtcccggttaccccggccccccggttcgttacccgtaacccgttccgtttaccccgttcccccgtcccccttacccggttccctccggtttaccccg

SEQ ID NO: 70122 - DNA, 905 bp, Homo sapiens
  misc_feature: GYAE6OF01DT6EW.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctccccctcctcactttctgcacagtctctgagtcctcctactgagctgacacagccaccctccggtgtcggtcgtcccacggaacgaaaccggaccgaggagtaacctacgtctctggaggatgcattagtaccaaaaaaactaaatgtcttcggtttaggtaccgaagaaaggaaggtacgacggccgaaccgggcccccgggttcggttgccgtaccattaccgttattaggaaccggaaaccaaaggtaaaaaacccggaacccccgttccccgggggtaactaccccttagggaaggtaacggtaactttccgttccgtccgggtacctaccccaaccccgttcggaacggggtaacccgaactcgggacccgtaaccgtttaggaacctaactcggtaacgggccggggggtaccccgaggggttaaggggacgggtaagtaaggtaacgggttaaggtaccgttaaacgttagttttacgtaacgttacccaacccgaaggaaacctacccgtaaagtaaggtaaaaacgtaccaaccgaagggtaagggtaaaagttaccggtttacggggaaccgggggaacggggaaccctaaacgggtccgttaccggaacccggttaaccccggtaggttacccggaaccggaccccggtaaaaccggggtcccgttacccgggttacccccccccttacccgggggttaccctaaccccggtttacccctttaccccgggtttaccccccccttaaacccccccttcccgttttaaccccgttccccccg

SEQ ID NO: 70123 - DNA, 659 bp, Homo sapiens
  misc_feature: GYAE6OF01D8PDR.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctggagactctcctgtgcagcctctggattcattctttgatgatttatgccatcgcactggactccgtacaaggccgtaccgggggaagggtcgtgggagttgggtcttcgttcttaagtttaagttgggagttggtggtatcctactactagtgcagtactcgtggtaggtaagggtcgtacttcaaccattcctaccaagaacgaaccaacgagaccaagtaaaccctcctagtactcgtcgaactaaatcgaaactacgtacctacgaaggtacgggtaggaacggtacccgtaccccgtaccctttactaaaccttacgttggtaacgtaaacgtaaaaaggttcgttaaacgggtaccaaaccccgtaccttaaccctttaagttttaccgaacccgtacgtacccgggg

SEQ ID NO: 70124 - DNA, 426 bp, Homo sapiens
  misc_feature: GYAE6OF01C7A45.49.26.C04.1.454.CMB.1.raw
  modified_base (386)..(386): a, c, t, g, unknown or other
  misc_feature (386)..(386): n is a, c, g, or t
  modified_base (413)..(426): a, c, t, g, unknown or other
  misc_feature (413)..(426): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacagaaaacgaccctccgggatccctgagagattctctggctccacctcgagggaccatcggccacgttgactatcaggcggggcccagggtggagatggaaggtgactactattgttactcaccagacaccagtagaaaatcaacagaggaatagttcggcggaggaccaagctcgaccgtctaggtcagcccgaagcctcgcccccgtcggtccactcctcgttccccacccttcctctctctcgactntcgagcggctgcgaagccgacagtagnnnnnnnnnnnnnn

SEQ ID NO: 70125 - DNA, 529 bp, Homo sapiens
  misc_feature: GYAE6OF01CK4PH.49.26.C04.1.454.CMB.1.raw
  modified_base (241)..(241): a, c, t, g, unknown or other
  misc_feature (241)..(241): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (518)..(518): a, c, t, g, unknown or other
  misc_feature (518)..(518): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgttggtaccagaagaagtcaggtcaggcccggtgttgctcatctatgacgacagaaacgacctcgggatcctgagagtattctctggctccacctcgagggaccagcggccacgttgactatcacggcggggccagggtggaggatggaaggtgactactattgtactcacanacacagtanaaatcanagagaatagtcggaggaggacaagctacgaccgtactaggtcacgccgaacggctcggccccctcggtcacctctcttacccnccctctcttcc

SEQ ID NO: 70126 - DNA, 398 bp, Homo sapiens
  misc_feature: GYAE6OF01EVML1.49.26.C04.1.454.CMB.1.raw
  modified_base (364)..(364): a, c, t, g, unknown or other
  misc_feature (364)..(364): n is a, c, g, or t
  modified_base (393)..(398): a, c, t, g, unknown or other
  misc_feature (393)..(398): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggccaggtggagatgaaggtgactactattgttactcaccagacaccagtagaaatcggacagagaatatcggcggaggaccaagctgaccgtcctaggtcacgcccaaggctcgcccctgtcactctcgtcccgcctcctctctctcnctctgacgcggctggcaaggcgcagtagnnnnnn

SEQ ID NO: 70127 - DNA, 398 bp, Homo sapiens
  misc_feature: GYAE6OF01BKCBX.49.26.C04.1.454.CMB.1.raw
  modified_base (396)..(398): a, c, t, g, unknown or other
  misc_feature (396)..(398): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctcgccccctggtcactctgttcccgccctcctctctctcgactctgagcggctggcaaggcgcatagnnn

SEQ ID NO: 70128 - DNA, 966 bp, Homo sapiens
  misc_feature: GYAE6OF01BJA1P.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggcctagcgtggtttcgtttcgttgtcgtactttaaagtttaaggtctacgtagtgtaagtagtcgacgttagggttgggtaagtacgttcgggggtaggggtacggttgggttaggtaacggccggtccggggggttcccggggttaccgtaggaaccgtccttccgtccgttggcgacgccgtccgttcggtagttctacttcgttttcgtagtagtagttatttacgtccgactagtcgacctaggtacgtaccgttacccgtaagaccggttccgggggtaacgggggtacggttcggtagggttacgggtttccgttactttccgtttaagtttttaaaggtttaggggtagggtagggtttcggttaacgttacctaacccgttaaccgttagttacggtaccgagtaacgttccgttaggttcggggtaaacgggtacgggttactttacctaacccgtaaccttaccgttcccgaaacggaaagggaaacctaaacccgaaacgggtaacctaaaccgggtaaaacccctttaccccgtttagttacgtttaacccgtcggtaaaacctaaaacggtttaagaacccgtaaacgtttccgttaccgaacggggttaaagggtacggggttaacccggaacccgtaacccccttcccggtttttacccctaagtttaaacccggtggtttaaccgaaaccggtttaaaaaaacggtaaccggtttttaccgggaaccccgttaacccaaacccggttaaccctttttaagttttaaccccggacccgtaaaccccgttggggtaaccccccgggg

SEQ ID NO: 70129 - DNA, 794 bp, Homo sapiens
  misc_feature: GYAE6OF01ECABZ.49.26.C04.1.454.CMB.1.raw
tcagagtcgagagacacgaccggtgctcgatttagtctagcgactttgggttgggggtgggctcgaggaggcagtagctctgggaatctcaccatcggcctggacccctctcctgcgtcccctcctcactttctgcacgagtctcgtgaggtcctcctatgagctgacacacgccctacccgtcggtcgtcggtccgtccccgaggacgaacggccacggactacctgctcgtggagtatgctattcgaaacctaaaaagtgtgtacgttagttacggtaaccaaggtaagtaacggtacgacgggacccgtaacgggtccccggttaggttacggcctacgtatctatacgaacgacgaacgtaaaaccgcccgtacggtacctcccgaggacggtacgtacgttcctcggtcggacctaccgaccgtcggacggacctaggttcggacctagttcgaactacgtacgacgggtccggggaccctaaggggtcggtaagggacgtaccgggtaaggtagaaccgtttagtaagtttcggtaactccgaaccgtaagaacccgtaacgtaaggtaacggtaaactacgtaacggaaggtaaacggtaaacgttaccggttacgggaacccgggtaaacggaacccgtaaggtaccggtacggaaccccggttaacggtaccgtaccgaaccggtacccggtaacggttaccaccccggtcccccggttaggtacccgttaacccgttcccgtacccggtttacccccctacccgttaccgttcccgtttacccg

SEQ ID NO: 70130 - DNA, 548 bp, Homo sapiens
  misc_feature: GYAE6OF01DLZ2V.49.26.C04.1.454.CMB.1.raw
  modified_base (241)..(241): a, c, t, g, unknown or other
  misc_feature (241)..(241): n is a, c, g, or t
  modified_base (526)..(526): a, c, t, g, unknown or other
  misc_feature (526)..(526): n is a, c, g, or t
  modified_base (537)..(537): a, c, t, g, unknown or other
  misc_feature (537)..(537): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagagtcaggccaggccccggtgttgctcatctatgacgacagaaaacgccctccgggatccctgagagattctctggctcacctcagggaccatggccacggtttgacttatcgaggcggggcccagggtacggaggagtggaagggtgactacttatttgttaactcaccagacaccgagtagaaaatcaacgagaggaatagttcgggacgggtagggaccaagctgaccgtccgtaggtcagcccgaaggctcgcccctcggtcnctctcgtcccnccctcctctcc

SEQ ID NO: 70131 - DNA, 415 bp, Homo sapiens
  misc_feature: GYAE6OF01ADU6Y.49.26.C04.1.454.CMB.1.raw
  modified_base (399)..(415): a, c, t, g, unknown or other
  misc_feature (399)..(415): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggccaggtggaggatggaaggtgactactattgtactcaccagacaccagtagaaaatcaacagaaggaatattcggcggaggaccaagctgaccgtctagcagcccaaggctcgcccctcggtcactctcgttcccacctcctctctctcgactctgagtcgggctggcaagggcactagtacgnnnnnnnnnnnnnnnnn

SEQ ID NO: 70132 - DNA, 774 bp, Homo sapiens
  misc_feature: GYAE6OF01D5QVP.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgtggtaccagaagaagtcaggccaggcccggtgttgctcatctatgacgacaagaaaaccgacccgtcgggactccctgagagtattctctggctccacctcgacgggaccagtcggccacgttcgaactataccgacggtccggggccccgagggtcgggaagggacgtaggaagggtacggaacttaacgttaatttacgttaaccgttaccaaccccgtaagaacccgtaacccgtaagtaaagaaaaacttaccgaaacgaagggtaaaggtaaagttaacggttaccggggaccggggtaacggggaaacccgtaaacgggtccgtaacggtaaccccgggttacccgtaacggggttacccgaaaccgggtaacccccgaaaccgggggtaccccttaccccgggtccccccccccggttaccgggttacccccgttaacccggtttaccccggttttacccccgggtttaccccccccttaaacccccccgtttcccccgtttacccccgttttccccccgg

SEQ ID NO: 70133 - DNA, 661 bp, Homo sapiens
  misc_feature: GYAE6OF01CAV7I.49.26.C04.1.454.CMB.1.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (576)..(576): a, c, t, g, unknown or other
  misc_feature (576)..(576): n is a, c, g, or t
tcagagtcgagagacacgaccggtgctcgatttagtctagcgactttggggtttggggtgggctcaggaggcagagctctgggaatctcaccatggcctcggaccctctcctcgctcccctcctcactttctcgcactcgtctctgacggcctcctatgagcgtgacgacacgccaccgtcggtgtcggtcgtcccgacggacgaacggccaggactaacgtgctcngganactgactatacgaaacctaaaaatctcgtacgttcgttacggtaccaagaagtaacgtcaaggccgacggtcccggtaggtcactacgtactacgtagtacgacgaacaacgaaaaccgccgtacggactctagagacgtatcgtctcggcctctaaccgcggaacggtaccaggtcggtacaacgttcgaacttaacgacgacggtccgggacctagggagacggtagagggtaagtctacgttactagttacgttacacgacctagacctataagaacgtaaatacgactaaaggataaactcggtacgggagggacgttaaaccgaagtcgtacgaacccgnggttaaccggactacggaaccgtacgtaccgtcccgacccggtcgtaacttccgcgttacccgtccctaccctcgtcctttaccg

SEQ ID NO: 70134 - DNA, 608 bp, Homo sapiens
  misc_feature: GYAE6OF01C04TL.49.26.C04.1.454.CMB.1.raw
  modified_base (430)..(430): a, c, t, g, unknown or other
  misc_feature (430)..(430): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctggagactctcctgtgcagcctctggattcattctttgatgattatgccatgcactggactccgtacaacggccggtccgggggaagggtcgtgggaggtcggggtcttcgttctttaagttaagttgggattgggtggtatcacctactatgcagtctcgtggtaggagggtcgtattcacctntcctacagacgacaacagcaacgtaacctccctagtactctgactaaatcgaactacgtactacgaggtagggtagacggaccacccgtccttactaccttacgtggtacgaacgtaaaaggtcgttaaccggcgtaaccctaacttacctttagttttaccgaccctacggtccggg

SEQ ID NO: 70135 - DNA, 584 bp, Homo sapiens
  misc_feature: GYAE6OF01B1JI2.49.26.C04.1.454.CMB.1.raw
  modified_base (416)..(416): a, c, t, g, unknown or other
  misc_feature (416)..(416): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagaggccgtggggggtccctgagactctcctgtgcagcctctggattcattctttgatgattatgccatgcacgtggactccgtcaagccgtccgggggaaggtcgtgggagtgggtctcttcttattaagtggatggtgtatcactatatgcagctcgtggtgaagggtcattcacctatctacaganacaacagacaacgtaacctcctagtactcgtagacaaatcgaaactagtaccgtacgaaggaggtacgacggtaccaacccgtccttactaacctacgtcgtacgaactaaaaggtcgttaacggtacaacccgtaactacctttatttaccgaccgtacgtaccggg

SEQ ID NO: 70136 - DNA, 611 bp, Homo sapiens
  misc_feature: GYAE6OF01C073N.49.26.C04.1.454.CMB.1.raw
  modified_base (240)..(240): a, c, t, g, unknown or other
  misc_feature (240)..(240): n is a, c, g, or t
  modified_base (461)..(461): a, c, t, g, unknown or other
  misc_feature (461)..(461): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgttggaccagaagagtcaggccaggcccgtgtgctcatctatgacgacagaaacgcccgtcgggactccctgagagattctcgtggctccacctcacgggaccagtcggacctacgttgactatcgacggccggggcccagggtgggaggagtaggaagggttagacttacgttatttcgttaactcaaccgtagaccaccagtaagaaactacanaggaaggtaattacggttacggacggggacgggaaccgaaggccgtacgtacccggtccgtacggaccgacggacccgacggccgtccggtccccccgtcggtacccaccgtttccttccgttacccccaccccttccgtccttaccccg

SEQ ID NO: 70137 - DNA, 771 bp, Homo sapiens
  misc_feature: GYAE6OF01CX4TT.49.26.C04.1.454.CMB.1.raw
tcagagtcgagagacacgaccggtgctcgatttagtctagcgactttgggtttggggttggggctcaggaggccagagactctgggatctcaccatggacctcggaccctctcctgccttccccctcctccactttcgtgcgacctaggtcgtctcgaggtcccttccgtagtcgagctgacacagccaccctcggtcgtcggtcgtccccaggacaacggccaggatacctggctcgtggagagtgctagttcgaccaaaaaatgtagtcttgtggtaccaaggaagtagtcgacgccacggtcccggtgttcgctcatcctatgacgacagaaaccgccgtcggactccgtgagagtagttcgtacgtgctaccacctcgaacggacctaggtcggacctaacgttcgaacgttacgtcgaacggtaccggggacccttaggggtacgggacggaaggttacggtaaaccgggttagtaaccgttaaaccgttaaggtttaccggtttaaccttaccaccgtaacgtaaccaacccgtaagttaaccggaaaaccttaccgaacgtaaagggaacggttaaactacggtttaccggggacgggtaacgggaacccgaaggtccgtacggtaacccggtttaccggtaaggtacccgtaacgggaccccgttaaaacgggttcccttacccggtccccccggttacggttaccgaccgtttacccgtttacccggttccccctaaccccgttccgttccctttaccccgg

SEQ ID NO: 70138 - DNA, 173 bp, Homo sapiens
  misc_feature: GYAE6OF01DHR7W.49.26.C04.1.454.CMB.1.raw
  modified_base (172)..(173): a, c, t, g, unknown or other
  misc_feature (172)..(173): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcgggctggcaaggcgcatagnn

SEQ ID NO: 70139 - DNA, 744 bp, Homo sapiens
  misc_feature: GYAE6OF01DDTGN.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcggtggtagagccgtggggggtccctgagactctcctgtgcagcctctggattcattctttgattgtattatgccatgcacgttggactccgtacgaaggccggtccgggggaagggtcgtgggacggtgggtctcttacttaagttaagttgggagttggtaggttactctacctactatgcaagtaccttcgtaggttacggaaggggttacgtactttaccgaaccctattacccgtacccaaaggaaccgtaaacaaacgaacgtaaccgaaacgtaaaacccgttccccttaggttaacttcgtaacgtaactaaaagtacgtaaactacggttaccctaacgtaggaacggggttacgaacggtacccgtaacccggtaccctttaccgtaaaccgttaccggtacggttaaccgtaaacgtaaaaacggttacgtttaaaccgggtaaccggtaacccttaaacccgttaaacccttttaacgttttacccgtaacccgtaacccgttaacccggg

SEQ ID NO: 70140 - DNA, 412 bp, Homo sapiens
  misc_feature: GYAE6OF01DVUC1.49.26.C04.1.454.CMB.1.raw
  modified_base (237)..(237): a, c, t, g, unknown or other
  misc_feature (237)..(237): n is a, c, g, or t
  modified_base (400)..(412): a, c, t, g, unknown or other
  misc_feature (400)..(412): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaaggtnactactatgttactcacagacaccagtagaaaatcaacagaggaaatagtcggcggaggaccaagctgaccgtcctaaggtcagcccaaggctgccccctgtcactctcgttcccaccctcctctctctcgacctctgacgcggctgggcaaggcgcaatagnnnnnnnnnnnnn

SEQ ID NO: 70141 - DNA, 708 bp, Homo sapiens
  misc_feature: GYAE6OF01C40VL.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaggtgtcagtgtgaagtgcagttggtgaatcgtgggggagtcgtggtagagccgtggggggtccctgagactctctgtgcacgcctctggattcattctttgatgtattatgcctatcgctacgtggactcccgtacgaaggtccgtaccgggggaagggttcgtggggaggttggggttccttacgtttactttaagtttaaggttgggtagtttgggttaggtaacttccgaacccgttatagttcggacacgtacgttcgtggtaggtaacggtcgtacttccaacgtatcctacgaagacgaacaacgacgtacaagtaaacccttccgtagtactccgtagaactaaacgtcgaacttaacgtcgtaacgtagggtaacggttcgaacggacccgttaccccggtctttaacccgtacgttaacgtcggtaacgtaaaccgtaaaaaggttcgtttaaacccgggactaaaccccttaaccggttaacctttaaggttttacccgaacccgtcggttaacccgggg

SEQ ID NO: 70142 - DNA, 607 bp, Homo sapiens
  misc_feature: GYAE6OF01EDZ3T.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctcctgtgcagcctctggattcattctttgatgattatgccatgcacgtggactccggtcaaggccgtcgggggaagggtcgtgggagtgggtctctcttattaagtggatggtgtatcactatatgcagactgtggtaggtaagggtctattccaacctactcctaccgagaacgaacaacagaccaacgtaaaccttcctgtactactagaactaaatgaaccagtcctacgaaggtaggtacgaacggacctacccggtaccttacgtaacctacgtacggtacgaacgtaaaaggtcgttaacggtacgtaaccctaacctaaccttacttttacgaaccctcgtaccggg

SEQ ID NO: 70143 - DNA, 406 bp, Homo sapiens
  misc_feature: GYAE6OF01BENUD.49.26.C04.1.454.CMB.1.raw
  modified_base (368)..(368): a, c, t, g, unknown or other
  misc_feature (368)..(368): n is a, c, g, or t
  modified_base (396)..(406): a, c, t, g, unknown or other
  misc_feature (396)..(406): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcgggccaggtggagatgaggtgactactattgttactcaccagacaccagtgaaaatcaaagaggaatattcggcggagggaccaagctgaccgtcctaggtcagcccaaggctcgcccctggtcactctcgttcccaccctcctctctctcgactcngagcgggctggacgaaggcgcacgtagnnnnnnnnnnn

SEQ ID NO: 70144 - DNA, 691 bp, Homo sapiens
  misc_feature: GYAE6OF01D7S85.49.26.C04.1.454.CMB.1.raw
  modified_base (297)..(297): a, c, t, g, unknown or other
  misc_feature (297)..(297): n is a, c, g, or t
  modified_base (416)..(416): a, c, t, g, unknown or other
  misc_feature (416)..(416): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgcttaatttaaaaggtgtccagtgtgaagtgcaggttggtggaatcgtgggggagtcggtggtagagccgtgggggtccctgagtctctcctgtgcagcctcgtggtattctattctttgatgtattancgaccatgcctacgtggtactccgacgaaggtccggtacggggtaggtcgtagggaggttcgggtcttacttacgttaagttaaggttgggagttagggtgtactaccgtactacgtancgacacgtactcgttaggtacggtaaggtcgtacttaccgacgtactccgtaccgaagaacgaacctaacgacgtaacctaaacgtaacccgttccgttacgtaacgttaccgtaacgtaacctaaagttaacgaaactaccggtacgtacggaaggtacggacgaaccgaccgtacccgtccttacctacgtacgtagtaacaaagtaaacgtacgtttaccgggactaaacccgtaaccttactttacggtttaccgacctccggtaaccggg

SEQ ID NO: 70145 - DNA, 401 bp, Homo sapiens
  misc_feature: GYAE6OF01C3G4O.49.26.C04.1.454.CMB.1.raw
  modified_base (393)..(401): a, c, t, g, unknown or other
  misc_feature (393)..(401): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcgggccaggtggaggatgaaggtgactactattgttactcaccagacaccagtagaaaatcaacagaggaatattcggcggaggacaagctgaccgtccaggtcagcccaaggctgcccctggtcactctcgtcccacctcctctctctcgactctgagcggctcggcaacggcgcagtagnnnnnnnnn

SEQ ID NO: 70146 - DNA, 578 bp, Homo sapiens
  misc_feature: GYAE6OF01AGEY1.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgctttgtggtaccagaagaagtcaggccaggccccggtgttgctcatctatgacgacaagaaaaccgccctccgggatccctgagagattctctggcctccacctcgaacggggacccagtcggccctacggttcgacttatcgaggccggggtcccagggtcgggaggagtaggaaggtggaactacttattgttactccaaccagaccaccagtacaaaatcaacagaaggtaataagttcggacgggaacgggaccaagccgtcgaaccgtcgtaggtccacgcccgaaggcctcggccccgtcggtcaccttctcgtccccacctcctctcc

SEQ ID NO: 70147 - DNA, 402 bp, Homo sapiens
  misc_feature: GYAE6OF01A7P8M.49.26.C04.1.454.CMB.1.raw
  modified_base (389)..(402): a, c, t, g, unknown or other
  misc_feature (389)..(402): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctcgggatccctgagagattctctggctccactcagggaccatggccacgtttgactatcagcggggcccaggtggaggatgaaggtgactactattgttaactcaccagacaccagtgaaaatcacagaggaatattcggcgagggaccaagctgaccgtcaggtcagcccaaggctgcccctggtcactctgttcccacctcctctctctcgactctgagcggctggcaaggcgcatagnnnnnnnnnnnnnn

SEQ ID NO: 70148 - DNA, 721 bp, Homo sapiens
  misc_feature: GYAE6OF01AUVEU.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaattgcttgtgtaccagaagaagtcaggccaggccccggtgttgctcatctatgacgacaagaaaacgccctaccgggactccctgagagacttctctggcctccacctcgaaggacctagtcggacctacgttcgactagtcgaacggtccggggacccgagggtgggaagggacgttagggaacgggttagaaccgttaacgttaagtttacggtttactaccaacccgtaacgaacctaacccgtaacgtaacgtaaaacgttacaacccgtaaggaaacggtaaaacgttaacgggtttaccgggaccgggtaaaccgggggaacccgtaaaggacccgttacggaacgtttacggtaccccgttaagggtaccgtaaccgggaccccgaacgggtacccgtacccggtccccccgtaccgggtttaccccaccgtttacccgttaccccgtttcccccggtcccccttcccgttcccccg

SEQ ID NO: 70149 - DNA, 555 bp, Homo sapiens
  misc_feature: GYAE6OF01BOWS2.49.26.C04.1.454.CMB.1.raw
  modified_base (241)..(241): a, c, t, g, unknown or other
  misc_feature (241)..(241): n is a, c, g, or t
  modified_base (374)..(374): a, c, t, g, unknown or other
  misc_feature (374)..(374): n is a, c, g, or t
  modified_base (541)..(541): a, c, t, g, unknown or other
  misc_feature (541)..(541): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgtggtaccagaagaagtcaggccaggcccggtgttgctcatctatgacgacagaaaaccgccctccgggactccctgagagtattctctggctccacctcgacgggaccatcggcctacgttgactancgaggccggggccagggtggacggagtggaaggtgaactacttattagttaactcaaccagaacaccagtagaaatcaacagaagaatagtcggacggtagggacaagcgtagaccgtctaggtcacgacccgaagcctcggccccctggtccactctccgttcccncccttccgtcttcc

SEQ ID NO: 70150 - DNA, 608 bp, Homo sapiens
  misc_feature: GYAE6OF01BYVCS.49.26.C04.1.454.CMB.1.raw
  modified_base (242)..(242): a, c, t, g, unknown or other
  misc_feature (242)..(242): n is a, c, g, or t
  modified_base (482)..(482): a, c, t, g, unknown or other
  misc_feature (482)..(482): n is a, c, g, or t
  modified_base (551)..(551): a, c, t, g, unknown or other
  misc_feature (551)..(551): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaaccaaaaaaatntgcttgttggtaccagaagaagtcaggccaggcccggttgttcgctcatctatgacgacaacgaaaaccgcccgtaccgggactcccgtagagagtattctctggcctaccgacctacgacgggaccagtcggacctacgttagactacgtcgacgggccggggacccgagggtaggaggtagtaggaaggtgacttagttagtttagtactaccacgacgaaccacgaagtacgaaacncaagagaaggatagtcggacggacggacaagcgtacgacccgtacgtacgccgacgaccgaaggtcccnccggtcccccgtcggtccaaccgttccgtccgttcccccgcccttcccttccgtccc

SEQ ID NO: 70151 - DNA, 705 bp, Homo sapiens
  misc_feature: GYAE6OF01DS0M8.49.26.C04.1.454.CMB.1.raw
  modified_base (551)..(551): a, c, t, g, unknown or other
  misc_feature (551)..(551): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
tcagagtcgagagacacgaccggtgctcgatttagtctagcgactttgggtttggggagagtgcattcgcccaaaaaaagttactgcttgttggtacctagaagaagtcaggccaggccccggtgttgctcaatctatgacgacagtaaaacgaccctcgggatccctgagagtattctcttaggctccactgagggaccatggccacgttgactatcgaggcggggccaggtgaggatggaagtgactactattcgtactcaccagacaccgagtagaaaactctaacgagtaggtaatagttcggacggacggaaccaaggtccgtacgaccgttaccgtaggtaccgaacggaccccgaagggccgttacgccccccgttcggtaccctaaccgttccgttaccggttacccccctaacccgtttcccttcccgttaccttaacccgtaccgtaacccgtttccgttaacggtaacgggtccggggtaccgttacggggaccgtaaaacggggtccggtacgtaaacggttaagcgtacacgactacncggtaagactaacgntacgacncgactcgtactacgtacgtacgtacgcgagacgtacgacgtacgacgtacgtacgtacgtcgtacgtacgtacgtagtagtcgtagaggtacgtacgtagacgtacggtacgtaggtcggtcgtacggtacg

SEQ ID NO: 70152 - DNA, 412 bp, Homo sapiens
  misc_feature: GYAE6OF01BCD43.49.26.C04.1.454.CMB.1.raw
  modified_base (292)..(292): a, c, t, g, unknown or other
  misc_feature (292)..(292): n is a, c, g, or t
  modified_base (400)..(412): a, c, t, g, unknown or other
  misc_feature (400)..(412): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgccctccgggatccctgagagattctctggctccacctcagggaccatggccacgttgactatcaggcggggcccagggtggaggatggaaggtgactactattgttactcaccagacaccagtagaaaatcacagaggaatattcggnggagggacaagctgaccgtctaggtcagcccaaggctcgccccctggtcactctcgtcccgccctcctctctctcactctgacgcggctggaccgaaggcgcactagnnnnnnnnnnnnn

SEQ ID NO: 70153 - DNA, 406 bp, Homo sapiens
  misc_feature: GYAE6OF01A8VEX.49.26.C04.1.454.CMB.1.raw
  modified_base (354)..(354): a, c, t, g, unknown or other
  misc_feature (354)..(354): n is a, c, g, or t
  modified_base (402)..(406): a, c, t, g, unknown or other
  misc_feature (402)..(406): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggaggaccaagctgaccgtctaggtcagcccaaggctcgccccctggtccactcctcgttccccncccttcctctctcctcgactctgacgcgggctggacaaggcgcatagnnnnn

SEQ ID NO: 70154 - DNA, 536 bp, Homo sapiens
  misc_feature: GYAE6OF01EECZV.49.26.C04.1.454.CMB.1.raw
  modified_base (241)..(241): a, c, t, g, unknown or other
  misc_feature (241)..(241): n is a, c, g, or t
  modified_base (323)..(323): a, c, t, g, unknown or other
  misc_feature (323)..(323): n is a, c, g, or t
  modified_base (454)..(454): a, c, t, g, unknown or other
  misc_feature (454)..(454): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
  modified_base (526)..(526): a, c, t, g, unknown or other
  misc_feature (526)..(526): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgccctccgggatcccgngagagattctctggcctccacctcacgggaccatcggacctacgttgactatcgaggcggggcccagggtcgggaggagtggaagggtgaacttagttatttgttactcaccgagaccacagtagaaactnaacagagaatagtcggcggaggacagcngaccgtctagcacgccgagcncgccccgtgccactctcgtcccncctcctctcc

SEQ ID NO: 70155 - DNA, 536 bp, Homo sapiens
  misc_feature: GYAE6OF01D15A5.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgccctccgggatccctgagagattctctggctccacctcagggaccagtggccacgttgactatcgagcggggcccagggtcggagagtgaaggtgactactattgttactcaccagacaccagtagaaatcaacagagaatagttcggacgggaggaccagctgaccgtctaggtccagcccaaggctcgccccctcggtcacctctacgttccccgccctcctctccc

SEQ ID NO: 70156 - DNA, 708 bp, Homo sapiens
  misc_feature: GYAE6OF01D0NPI.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctcgtggagatgcattcgaccaaaaccgntatgacttattggtaccagcagaacgccggccacggccctgtgttggtgatagtaataaagacacgtggagacggccctgagggtactccgtgagcgtattcctcgtcggcctccgacgggtacgaaggggaacctaacgggtccaacgtacgttcgggaccctaagtccgaaggtgggaacgtcccgaagggtaccggaagggagggaaccgggaggtcgttaggtaacgtttaatttagtttacggtaactaaactacctaaacgacgtaaccacctaagtttacggttaacttagttacgttaccgttacggtaacgtcggtaccgtaaaccgtaacgggttcccgacccggttcccggtacgggtaccaacccggacccccgtaaacgggaacccccctaacccccgtaacgttcccggtaccctaaccctttccgttaccccgtttccccccgtaaccccc

SEQ ID NO: 70157 - DNA, 815 bp, Homo sapiens
  misc_feature: GYAE6OF01D52NO.49.26.C04.1.454.CMB.1.raw
  modified_base (245)..(245): a, c, t, g, unknown or other
  misc_feature (245)..(245): n is a, c, g, or t
tcagagtcgagagacacgaccggtgctcgatttagtctagcgactttgggtttggggtgggctcaggaggcagagctctgggaatctcaccatggcctggaccctctctgctccccctctcactttctgcacagtctctgaggcctctatgagctgacacagccacctcggtgtcggtcgtccccaggacaacggccaggactaacctgctcgtggagatgctattacgaaacctaaaaaaattntgtactttaggttacggtaaccaaggaaagtaagtcacggccgacggcccggttgttcgctcatctagtcgacgaacaacgaaaaccgcccgtaccggactccgtagacgagtacttctacgtcggcctaccaccgtcggaacgggtacctaggtacggacccgtacgttagaaccttacgtaccggacggggcccggggacccgtaggggtacgggaagggtacgtaagggtaacggttacggaaacgtttacgtttaacgtttacgttaacccgtaccgaaacccgaacgtaacccgaaccgttaaacggtaaacgaaaaccgtacaaacggtaacggaaggttaaaacgtacggttaccggggaaccgggtaacgggaaacccgtaaacgggtccggttaccggtaacccggttaaccggttaacgggacccgtaaaccggtaccccggtaaacggtccccggtttacccccgggaccccccggtttcccgggttaacctaaccccggtttcccggttacccccggtttaccccccggtcccctttcccccgtttcccgttaccccg

SEQ ID NO: 70158 - DNA, 772 bp, Homo sapiens
  misc_feature: GYAE6OF01B2KEV.49.26.C04.1.454.CMB.1.raw
tcagagtcgagagacacgaccggtgctcgatttagtctagcgactttgggttgggggtgggctcgaggacggcagtagccttctgggaatctcaccgatcggcctggaccctctcctcgcgtcccctctctactttctgcacgagtctcgtgaggtcctctatgtagcttgaccacgacgccctacccgtcggtcgtcggtccgtccccacggacgaacggccaggactaacctgcctcgtaggagacttggcagtttacgaaacctaaaaaagtcgtacgtacgttaggttacggttaccaaggtaaagtaggttaccgagggtaccgtacgggcccggttaggtacgaccgtacgtattcctaagtacgaaccgtaacgaacgtaaacccgtcccgttaccgggtacttccccgaggtacggtaacgttcgttcgtccggtacggacccttaccgtaccgtacggacgggtaccctaggtccggaccttacggttacgaactacgacgtacggaccggggtacccagggtacggacggttacagggtaacgttacggattacgttagttacgtacgtacgacgtacgaacgtaccgtaaggttaacgaactacgtacgaaggaacgttagtacgggttaccggaacggaaccggtactaacgtccgtacggtacccgtacggtcgaccgtacgtacccggaggtacctacccggacccgttgtaccgtaccgttccggtaccccttaccctcccgttcgtacgtttcccg

SEQ ID NO: 70159 - DNA, 394 bp, Homo sapiens
  misc_feature: GYAE6OF01B0P16.49.26.C04.1.454.CMB.1.raw
  modified_base (286)..(286): a, c, t, g, unknown or other
  misc_feature (286)..(286): n is a, c, g, or t
  modified_base (388)..(394): a, c, t, g, unknown or other
  misc_feature (388)..(394): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggccaggtggaggatgaaggtgactactattgttactcaccagacaccagtgaaaatcacagagaatatcggngaggacaagctgaccgtctaggtcagcccaaggctgccccctggtcactctgttcccacctcctctctctcgactctgagcgggctggcaaggcgcatacgnnnnnnn

SEQ ID NO: 70160 - DNA, 1025 bp, Homo sapiens
  misc_feature: GYAE6OF01BOFJX.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggcctcctatgagctgacacagccaccctggtgtcggtcgtccccaggacaaacggccaggactaacctgctcgtggagatgactaagttacgaaacctaaaaaaaattgttcgtacgtttaggtttacggtaaccgaaggtaaaagtaacggtacgacgggtcccgaacggggtcccccgggttgttcgcttactacttactagtacggaaccgaaacgaaacggaaaacccggtaccccggtacccggggtaacctaccccggtaggaacggtaacgttactttcgttccggtaccggtacctacccgtacccgtacggaacggggtaccctacggtaccggaccgttaacggttcgtaaccgttacgtaccgggaccggggtaccccggggggtacccggtaaaggggtacggggtaacgggtaacgggttaacggggttaacggggttaaccggtaaccgttttaaccggtttaacggttttaaccggttaacccgtaccccgtaaacccggttaaaccgtaaaaccccggtaaacccggttaaagggttaaaaccgtaaaaccgttaaccggtaaacggtaaaacgggtaaacgggttaaacgtttaacccgggggttaaccgggggaaacccgggggaaaccggggttaaacccgtaaccggggtaacccgttaacccgggttaaccccgggttaaccgggttaaacccgggtacccgtaaaaccccggggtaccccgggtaaaccggtcccccgggttcccccgggttaccccccccgggttaccggttaaccccgttacccccgttttaccccggttacccccccggtttacccccctaccccgttttcccccttaacccggtttccccccg

SEQ ID NO: 70161 - DNA, 396 bp, Homo sapiens
  misc_feature: GYAE6OF01B80YO.49.26.C04.1.454.CMB.1.raw
  modified_base (388)..(388): a, c, t, g, unknown or other
  misc_feature (388)..(388): n is a, c, g, or t
  modified_base (394)..(396): a, c, t, g, unknown or other
  misc_feature (394)..(396): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgtactcaccagacaccagtgaaaatcaacagaggaatattcggcggagggaccaagctgaccgtcctaggtcagcccaaggctgccccctcggtcacctctcgttcccgcctcctctctctcgctctgagcggctggcaggcncatagnnn

SEQ ID NO: 70162 - DNA, 600 bp, Homo sapiens
  misc_feature: GYAE6OF01A9TQU.49.26.C04.1.454.CMB.1.raw
  modified_base (245)..(245): a, c, t, g, unknown or other
  misc_feature (245)..(245): n is a, c, g, or t
  modified_base (479)..(479): a, c, t, g, unknown or other
  misc_feature (479)..(479): n is a, c, g, or t
  modified_base (584)..(584): a, c, t, g, unknown or other
  misc_feature (584)..(584): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggactaacctgctcgtggagatgcattcgaaccaaaaaaatntgtctttggttggtaccagaagaagtcaggccaggccccggtgttgctcatctatgacgacaagaaaaccgacccgtccgggactccctgagagtattctcgtggcctcccacctcgacgggacctagtcggcctacgttcgactatcgacggccggggcccgagggtgggaggagtggaaggtcgaacttactagtttcgttactcaaccgagacaccgagtaagaaatcaanaagaagaatacgtcgggacggacggaccaggctacgaccgtcgtaggtcacggaccgaacggtcctccggcccccgtggtcccacgttccgttacccgttccccncccttccctccttccg

SEQ ID NO: 70163 - DNA, 546 bp, Homo sapiens
  misc_feature: GYAE6OF01A60AK.49.26.C04.1.454.CMB.1.raw
  modified_base (239)..(239): a, c, t, g, unknown or other
  misc_feature (239)..(239): n is a, c, g, or t
  modified_base (533)..(533): a, c, t, g, unknown or other
  misc_feature (533)..(533): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctggtgtcggtgtccccaggacaaacggccaggataacctgctctggagatgcattgaccaaaaaatntgcttgtgtacagagaagtcaggccaggccccggtgttgctcatctatgacgacagaaaaccgcctccgggatccctgagagtattctctggcctccacctcgacgggaccagtcggcctacgttgactatcgaggccgggcccgaggtgggaggagtagaaggtgacttactagttcgtactcaccagacaaccagtagaaatcacagagaatagtcggacgggaggaccaagctacgaccgtcgtaggtacacgacccgaggctccgccccctcgctacctcttccgtcccnccctcctcctccg

SEQ ID NO: 70164 - DNA, 676 bp, Homo sapiens
  misc_feature: GYAE6OF01CTFLE.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtggggggtccctgagactctcctgtgcagcctctggattcattctttgatgtattatgccatgcacgtggactccgtacaacggccgtccgggggaaggtcgtagggtacggtcgggtccttcgttactttaagtttaagttggggtattgggttggttactcctaaccttactagtcgacgtacgtacgttcgttaggtaggtaacggggttctaactttcccgaaccctattcccgtaccgaagaacgaaccaaaccgagaccaaacggtaaacccttcccgttagttaacgtctaacgtaactaaagtacgaactacggtcctaggaggtaggtagaaccgtacccgtaacccgttcccttacgtaaccttcgtagtacgtaaacaaacggttacgttaaccggcgtaaccctaaccg

SEQ ID NO: 70165 - DNA, 581 bp, Homo sapiens
  misc_feature: GYAE6OF01B4YUQ.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaattgcttgttggtaccagaagaagtcaggccaggccccggtgtgctcatctatgaacgacaagaaaacgccctaccgggactccctagagagattctctggctccacctcgagggaccagtcggacctacgttgactatcgacggcggggcccagggtggaggatggaaggtgaacttacgtatttagttactctaccgaataccgaccaagtaacgaaaatcaagaaggaagtaatacgttcgggacgggtagggaccaagctacgaccgtctagggctacgcccgaaggcctcgcccccgtggtaccaccgtccgtccgttccccgccttccctcgttccc

SEQ ID NO: 70166 - DNA, 583 bp, Homo sapiens
  misc_feature: GYAE6OF01EWE0I.49.26.C04.1.454.CMB.1.raw
  modified_base (462)..(462): a, c, t, g, unknown or other
  misc_feature (462)..(462): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctcctgtgcagcctcgtggattcatctttgatgattatgccatgcactggactccgtcaagccgtccggggaagggtctgggagtggtctctacttattaagttgggatggtgtactcactactatcgacagtactcgtggtagtaagggtctacgttcacctatctaccagacgaacaacagacaacgaaacctccgtagtactcgtanacaatacgaacacgttacacgtaaggaggtacgacggtaccaccgtccttactactactcgtacgaactaaagtagttaccgtacgaaccctaactaccttaatttcgaacctcgtacggg

SEQ ID NO: 70167 - DNA, 769 bp, Homo sapiens
  misc_feature: GYAE6OF01B5TQI.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatgggagtttgggctgagcttgggttttccttgttgcttattttaaaaggtgtccagtgtgaagtgcagttggtggaatcgtgggggagtcgtggtagagccgtggggggtccctggagactctcctgtgcacgcctcgtggattctattctttgatgtattatgccatgcacgtggactccgtacgaacggtccggtaccgggggaagggttccgttaggggacggttcggggttccttaccgtttacgttttaagtttaaaggttggggtaagtttggggttacggttaactacccgtaaacccgtttaacgttacgttacggaccgtaacgggtaccttaccggttagggttaccgggtaaacgggggttccttaacgtttaccccgaaccttacgttcccgtaaccccgaaagggaaacgaaacccgaaacgaacggacctaaaccgtaaacccttcccgttagtaaccttacgtaacggaacctaaaagttcgaaaaccgttcgtaacgtacggaaggttacgggtacgaaccggtaccctaaccccgtcctttacgtacgtacgtagtaacgtaacgtaaagtcgttaacggacacccgtaacttacttactttacaccgtcgtaccgg

SEQ ID NO: 70168 - DNA, 771 bp, Homo sapiens
  misc_feature: GYAE6OF01DEBHV.49.26.C04.1.454.CMB.1.raw
  modified_base (245)..(245): a, c, t, g, unknown or other
  misc_feature (245)..(245): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagcccaccctcggtgtcggtcgtcccaggacaaacggccaggataactgctctggagatgctattagaaacctaaaaaatntgcttaggttaggtaaccaagaagaagtcacgggaccgacgggccccggttgttcggcctacgatctagtacgacgaacaacggtaaaaccgacccgtacgggacctcccgtaggacgagtacttctcgtcggtcctacctaccgtaccgacgggaccagtcggaccctacggttacgaccttaacgtccgacggggtccggggacccgtaggggtacgggagggtaagtacgggtaagggtacgtaacgttaacgttaagttttacggttaacctacctaaacgaacgaaccgtaaccgtaagtaaacggtaaaactacgtaaacggaaggtaaacggtaacgttaacggtaccggggtaacggggaaccgggaaccgaacggtacgtaacggtaccccgttaacggtacggtaccgaacgggaccccgaaccgggtccgtacccggtccccccggttacgggttacccctaccgttacccgttaccccttaccccgtacccccttccccgtcctttacccccgg

SEQ ID NO: 70169 - DNA, 577 bp, Homo sapiens
  misc_feature: GYAE6OF01B9MBW.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctcctgtgcagcctctggattcatctttgatgattatgccatcgcactggactccgtacaaggccgtaccgggggaagggtcgtggaggtgggtctcgttacttattaagttggtagtggtggtatcacctactatgcagtactctggtgaagggtcattcaccatcctacagtacgaacaacacgacaacgaaacctccctagtactcctagacaaatcgaaactagtcgtactaggaggtagacggaccaccgtccttactactactgtcgaacgaaaggtcttacggacaccctactacttagtttacaccctgtacccggg

SEQ ID NO: 70170 - DNA, 677 bp, Homo sapiens
  misc_feature: GYAE6OF01DSUEY.49.26.C04.1.454.CMB.1.raw
  modified_base (196)..(196): a, c, t, g, unknown or other
  misc_feature (196)..(196): n is a, c, g, or t
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
  modified_base (655)..(655): a, c, t, g, unknown or other
  misc_feature (655)..(655): n is a, c, g, or t
tcagagtcgagagacacgaccggtgctcgatttagtctagcgactttggggtttggggggctctggggaaaggagccccagccctgagattcccaggtgtttccattcggtgatcagcactgaacacagaactcaccatgggagttgggctgagcgtggtttcttgttgctatttaaaggtgtcagtgtgaagtgnagttggtggaatcgtgggggagtcggtggtagagccgtggggggtccctgagactctcctgtgcacgcctntggtattcattctttgatgattangacctatgctacgtggactccgtacgaaggccgtaccgggggaaggtcgtgggtaggttcgggtcttcgttacttaagttaagttggggtagttgggtacgttactcaacccttatagtgactagtacttcgtaggtacggtaaggggtactatactaaccctattccgacaaggaaacaacaaacgacgaccaaacgtaaacccctttcctaggttaactcggtaacaacgtaagtactaaacgtcttacaggaggtaaggtacgaaccgggtacctaacccggttccttactaaaccttcgtagggtaacaaaaccgtaaaaggttacggttaaaccggcaaaaccccttgtaaaccctttntttaccaacccgtgtacccggg

SEQ ID NO: 70171 - DNA, 600 bp, Homo sapiens
  misc_feature: GYAE6OF01ARSEJ.49.26.C04.1.454.CMB.1.raw
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (270)..(271): a, c, t, g, unknown or other
  misc_feature (270)..(271): n is a, c, g, or t
tcagagtcgagagacacgaccggtgctcgatttagtctagcgactttgggtttgggggctctgggaaaggagccccagccctgagattcccaggttgtttccattcggtgatcagcactgaacacagaactcaccatggagtttgggctgagcggtcgttcgtcgtaggcgtactaagtagcngngnatnctgtgtgatggtgggatcgtgagcgtcgtggggcctggactctcttcgngtcacnctcgtgtagtacttctacgttagtnntatatagtctctacgtgctacgtacgtactacgtacgacggtacggtacggtacggtgtaggtacgtcgtcgttacgttacgttagtaggtaggtgtagtcgtactacgtactacgtcgtacgagtacgtacgtacgtagtacgtacgtacgtacgtacgtactactactacgtagaacgacacacgacactactacgtacgtacgtactacgtacagtacgtactacgtcgtacgtagtacgacgacgtaccgtactactactacgtacgtacgtacgtaagtacgtacgtacgtacgtactacttacgtacgtacgtcgtcgtaccg

SEQ ID NO: 70172 - DNA, 785 bp, Homo sapiens
  misc_feature: GYAE6OF01CD053.49.26.C04.1.454.CMB.1.raw
  modified_base (232)..(232): a, c, t, g, unknown or other
  misc_feature (232)..(232): n is a, c, g, or t
  modified_base (254)..(254): a, c, t, g, unknown or other
  misc_feature (254)..(254): n is a, c, g, or t
  modified_base (415)..(415): a, c, t, g, unknown or other
  misc_feature (415)..(415): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgacggcctcctatgagctgacacagcccaccctcggtgtcggtcgtcccccgaaggaccaaacggccaaggactaacctgcctcgtgganatgcattagaaaccaaaaaatntgtcttgttaggtacagaagagtcgacggccgacggcccggttagtcgctctatctagtcgaacgacaacgaaaaccgcccgtaccgggactcccgtagagtacgacttaccgtcgtcggtcctaccacctacgacgggacctacgtcggacctacgttanactagtcgacgggtccgggacccgagggtacgggaggtaagtagggtaaagggtacgtaacgtttaacgtttagtttaccgttaaccgtaccctaaacccgaacgaaccccgtaaacgtacgtaaaacgtaaaaccgttacgaaacggtaaacgtaaacggtaaacggttaacggttaccgggaacggggtaacgggaaaccgtaaccggtacccgtacggtacccggttacccggtaacggtaccccgaacggtaccccggaaccggtaccggttcccccggtcccccgttacccgggttacccttaccccgtttaccgttacccccgtttaccccctaacccccgttttccctcccgtttaacccccg

SEQ ID NO: 70173 - DNA, 682 bp, Homo sapiens
  misc_feature: GYAE6OF01BDT40.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagccgtccggggaaggtcgtggagtgggtctctcttattaagttgggatggtgtatcacctatatgcagactcgtgtggtaagggtctattccacctatcctcaagacgaacaacgagacaagaaaccctccctagtactcgtagacaaattcgaaactagttacctacgaagggtacgggttacgaaacgggtaaccctacccccgggttacccttttacccgttaaacccgttaacgttacgggttaacggtaaaccctaaaaaaacgggtttccggtttaaaacccggggttaccgaaaccccccgttaaacgttaaaccccctttttaaggtttttaccccggaaaccccgttaacccggttacccggggg

SEQ ID NO: 70174 - DNA, 696 bp, Homo sapiens
  misc_feature: GYAE6OF01C89HS.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaaccaaaaaaatntgcttgtggtaccagaagagtcaggcacggcccggtgtgctcatctatgacgacaagaaaaccgacccgtccgggactcccgtagacgagtatttctcgtcggcctccaccgtcgaacggaccagtcggacctacgttcgactacgtcgacggccggggaccaggggtgggagggagtaggaagggtagtaactaacgttagtttacgttacctacgaacccgaacgaaccaacccgtaaggttaacgaaaactccgaagaaggaagggtaaagttaggttaccggggacggggtaacgggaaccgtaacgtccgtacggaaccggttaccgtaacgggtccgaacggaccccggtaacgggtcccgttcccggcccccccgttacgggtaccctaccgttcccgtttaccccgtttaccccctaaccccccgttcccgtttcccgttaccccg

SEQ ID NO: 70175 - DNA, 749 bp, Homo sapiens
  misc_feature: GYAE6OF01D486G.49.26.C04.1.454.CMB.1.raw
  modified_base (190)..(190): a, c, t, g, unknown or other
  misc_feature (190)..(190): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (264)..(264): a, c, t, g, unknown or other
  misc_feature (264)..(264): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (542)..(542): a, c, t, g, unknown or other
  misc_feature (542)..(542): n is a, c, g, or t
tcagagtcgagagacacgaccggtgctcgatttagtctagcgactttgggtttgggggctctgggaaaaggagccccagccctgagattcccaggttgtttccattcggtgatcagcactgaacacagaactcacagtggtagtttggctagagtcggtgttcgtagtagcgttaattaaagtgcagtgngagtgagtgttgagactggagggtgtgtggtagcgtcggttccgggactgganctctctganacgtcgccttgngtaatttgcttggtttaanagtntacgtcgngactagtcggactagttccgtccgagtaccggttacggggtaaccgggtgttcgaaggtcggttcgttactacgttaagtttacggttttaggagggttaacgtcggttaattacacctaacgttagagtcgtaacgacgttacgtaggttacggttaaacggtcgtaaactacgtaactaaccgtacgtacgaccgaacgaacgaacaacgaacgtacgtaacgtaaccgtacgttaacgtacgtnacgtaacgtaacgtaacgtaacgtaacgtaacgtacgtaacggtacggtaacggaaccggtaaccgtaaccgtacccgttaccgtaaccgttaaaccgtaacgttaaacggtaaacggtaaacgttaaacggttaccggttaaccgtaaaccgtaacccgttaaccgttaacgttaccgttacccgtaaccggtaccggtaacccgg

SEQ ID NO: 70176 - DNA, 832 bp, Homo sapiens
  misc_feature: GYAE6OF01BK6LO.49.26.C04.1.454.CMB.1.raw
  modified_base (255)..(255): a, c, t, g, unknown or other
  misc_feature (255)..(255): n is a, c, g, or t
tcagagtcgagagacacgaccggtgctcgatttagtctagcgactttgggtttggggtgggctcaggaggcagagctcgtgggaatctcaccatggcctggaccctctcctgctccccctctcactttctgcacagtctctgaggcctcctatgagctgacacacgccaccctcggtcgtcggtcgtaccccgaggacaaacggccaggactaacctgctcgtggagagtgactattacgaacctaaaaaaagtntgtcttgttacggtaccagaagaagtcaggccgacggcccggtgtcgctcatctagtcgaacgacgaacgaaaaccgccccgtcgggaactcccgtaggaacgtacgtacttcgtcgtcgggtcctacccgaccgttacggaaccgggtacctaggtaccggacctaacggttacgtaactaacgtcgaaccgggccgggacccgtagggtcgggagggtagtagggtaaggtacgtacgtttaacgtttaggttaccgtttaaccaccgtaaccgaacgtaacccgtaacgtaacggtaaacgtaaacgttaccgaaacgtaaccgggtaaagggtaaaactttcggggttaacccggggaaccggggttaaacggggaacccgtaacgggtaccggtaaccgggtaccccgttaaccgggtaacggttaccccggaaacccggttaaccccggtaaccgggtacccggttcccccggttaccccccggaccggggtttaacccctacccgttttccccgggttaccccctttaacccccccggtccccctttccccgttcccggtttaccccccg

SEQ ID NO: 70177 - DNA, 404 bp, Homo sapiens
  misc_feature: GYAE6OF01D138P.49.26.C04.1.454.CMB.1.raw
  modified_base (253)..(253): a, c, t, g, unknown or other
  misc_feature (253)..(253): n is a, c, g, or t
  modified_base (390)..(390): a, c, t, g, unknown or other
  misc_feature (390)..(390): n is a, c, g, or t
  modified_base (398)..(404): a, c, t, g, unknown or other
  misc_feature (398)..(404): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgccctccgggatccctgagagattctctggctccacctcgagggaccagtggcctacgttgactatcgaggccggggcccaggtggagatgaagtgactactattgtacncaccagacacagtagaaatcacagagaatagtcggcggaggacagctcgaccgtcgtaggtcacgccgaagcctcgcccctcggtcactctcgttcccacctcctctctctcactcgtgacgcggctggcaaggccnacgtagcnnnnnnn

SEQ ID NO: 70178 - DNA, 425 bp, Homo sapiens
  misc_feature: GYAE6OF01BHTW5.49.26.C04.1.454.CMB.1.raw
  modified_base (78)..(78): a, c, t, g, unknown or other
  misc_feature (78)..(78): n is a, c, g, or t
  modified_base (253)..(253): a, c, t, g, unknown or other
  misc_feature (253)..(253): n is a, c, g, or t
  modified_base (407)..(425): a, c, t, g, unknown or other
  misc_feature (407)..(425): n is a, c, g, or t
tcagagtcgagagacacgaccggtgctcgatttagtctagcgactttgggtttggggagatgcattgccaaaaaaatntgcttgttggtaccagaagaagtcaggccaggccccggtgttgctcatctatgacgacagaaaacgaccctccgggatccctgagagattctctggactccacctcagggaccatggcccagttgactatcaggcggggcccaggtggaggatgaaggtgactactattgttacncaccagacacagtagaaaatcaacagagaattatcggacggaggacaagctcgaccgtctaggtcacgcccaaggctacggccccctggtcactctcgttccccacctcctctcctctcgactcgtgacggcggctggaccaaggcgacatagnnnnnnnnnnnnnnnnnnn

SEQ ID NO: 70179 - DNA, 903 bp, Homo sapiens
  misc_feature: GYAE6OF01EB1MD.49.26.C04.1.454.CMB.1.raw
  modified_base (232)..(232): a, c, t, g, unknown or other
  misc_feature (232)..(232): n is a, c, g, or t
tcagagtcgagagacacgaccggtgctcgatttagtctagcgactttggggtttgggggctctgggaaaggagccccagccctgagattcccaggtgtttccattcggtgatcagcactgaacacagaactcaccatggagtttgggctgagctgggttttccttgttgtcttaattttaaaaggtgtccagtgtgaagtgcagttggtggatcgtggggagtcgtggtagngccgtgggggtccctgagactctcctgtgcagcctcgtggattcattcgtttgattagtattatcgacctatcgactacgtggtactccgtacgaacggtccggtaccggggggtaacgggtcggtacgggtaggtttacgggtcttacgttaccgttttaaagtttaaaggtttggggtaagtttacggggttaggttaacttacccgtaaacccgtttacgtttaacgtcggtaccgtaacgttaaccgttccggttagggttaacgggtaaacgggggtttaccgttaacgtttacccgtaacccttaacgttccccgtaaccgtaaacgggaaacgtaaacccgaaaacgtaccggtaaacccgtaaaccgggttaaaaccccctttcccccgttaaggtttaacttacccgttaacggtaaaaccctaaaaggttaacgaaaccggttaacgttccggaaaccggtaaggtacggggttaaccggtaaacgggtaccccgttaaaccccgttcccgttttaaccgtaacccgttaccggttagggtaaccgttaaaacccgtaaaaagggttcccggttaaaaccgggttaacccaaccccggtttaaacccttaacccggtttttaaacgtttacccggaaccccgtttaacgggtaccccgggg

SEQ ID NO: 70180 - DNA, 601 bp, Homo sapiens
  misc_feature: GYAE6OF01DFR7L.49.26.C04.1.454.CMB.1.raw
  modified_base (405)..(405): a, c, t, g, unknown or other
  misc_feature (405)..(405): n is a, c, g, or t
  modified_base (445)..(445): a, c, t, g, unknown or other
  misc_feature (445)..(445): n is a, c, g, or t
tcagagtcgagagacacgaccggtgctcgatttagtctagcgactttgggtttgggggctctggggaaaggagcccccagccctgagattcccaggtgtttccattcggtgatcagcactgaacacagaactcaccatggagtttgggctgagctgggttttccttgttgcttaattttaaaaggtgtccagtgtgaagtgcagttggtggaatcgtgggggagtcgtggtagagccgtggggggtccctgagactctcctgtgcagcctctggattcattctttgatgatttatgccatgcactggactccgtacaaggccgtaccgggggaagggtctgggagtgggtctcttctttaattaagttgggtattgggtagtataccaaccttctatgcagcttntggtaggaagggtcattcaccatcctacagagaacaacanacaacgtaacttccctagtactctagactaaatagaaactgtacctacgaggtaggtaggacggaccgtaccgtaccctttacgtaacttacgtagtacgaaataaaggtacttaacggacgaaccctacttaaccttatttacgcctacgtcggg

SEQ ID NO: 70181 - DNA, 406 bp, Homo sapiens
  misc_feature: GYAE6OF01CMMSA.49.26.C04.1.454.CMB.1.raw
  modified_base (395)..(406): a, c, t, g, unknown or other
  misc_feature (395)..(406): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaactaccctccgggatccctgagagattctctggctccacctcagggaccatggccacgttgactatcagcggggcccaggtggaggatgaaggtgactactattgttactcaccagacacagtgaaaatcacagaggaatattcggcggaggaccaagctgaccgtcctaggtcagcccaaggctcgccccctggtcactctgttccccaccctcctctctctcgactctgagcggctggacaaggcgcatagnnnnnnnnnnnn

SEQ ID NO: 70182 - DNA, 422 bp, Homo sapiens
  misc_feature: GYAE6OF01BUG5H.49.26.C04.1.454.CMB.1.raw
  modified_base (161)..(161): a, c, t, g, unknown or other
  misc_feature (161)..(161): n is a, c, g, or t
  modified_base (212)..(212): a, c, t, g, unknown or other
  misc_feature (212)..(212): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (405)..(405): a, c, t, g, unknown or other
  misc_feature (405)..(405): n is a, c, g, or t
  modified_base (411)..(422): a, c, t, g, unknown or other
  misc_feature (411)..(422): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacagaaaacgaccctccgggatcccngagagattctctggcctccacctcgacgggaccatcggccacgttgactancgaggccggggccagggtggaggataggaagtgactacgttattgtactcaccagacacgagtagaaatcacgagagatagtcggacgaggacaagctacgaccgtcagtcacgcccaagctccgcccctaggccactctcgtcccgcctcctctcnctacnctcgtgacggtcggcgtggcgaacggcgacngtagcnnnnnnnnnnnn

SEQ ID NO: 70183 - DNA, 722 bp, Homo sapiens
  misc_feature: GYAE6OF01EF074.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgctattttaaaaggtgtccagtgtgaagtgcagttggtggaatcgtgggggagtcgtggtagagccgtggggggtccctgagactctcctgtgcacgcctctggtattctattctttgattgtatttatcgccatgactactgggactccgtacaacggtcggtccgggggaagggtcgtagggaggttcgggtcttcttactttaagttagttgggtattcgggtaggttactactaacttactatcgactagtacctgttaggtaggtaacgggttctaattccgaaccttacttccgtacgaaggaacgaaccaaacgacggaacctaaacgtaaaccctttccctagttaactcgtacgaacttaaacgtacggaaacctacggtaccttagaacgggtaggtaacggaccggtaccctaccccggttccttacgttaaaccgtacgttagggtaacgtaaaccgtaaaacggttcgtttaaaccgggacccaaaccccgttaacctttaaccttttaagttttaccccggaacctacggttacccgggg

SEQ ID NO: 70184 - DNA, 728 bp, Homo sapiens
  misc_feature: GYAE6OF01DB0IK.49.26.C04.1.454.CMB.1.raw
  modified_base (244)..(244): a, c, t, g, unknown or other
  misc_feature (244)..(244): n is a, c, g, or t
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggcctcctatgagctgacacagccaccctcggtgtcggtgtccccaggacaaacggccaggactaacctgctctggagatgcattagaaccaaaaaatntagcttggttcggtaccaagaagaagtcgaggccacggccccggtgttcgctcatctatgacgacaagaaaccgcctcgggactcccgtagacgagtattctctacggcctccacctcgaacgggaccagtcggaccgtacggtttacgaacttaacgtcggacgggcccggggacccgtagggggtacgggacggggtaagtacgggaagggttacgtaaccgttaacgttaacgttttacgttaaccttaccgaacccgtaacggaacctaacccgtaaaggttaacgaaaacttacgaaacgaaacgggtaaggtaaaacggttacggtttaccgggggaaccgggtaacgggtaaccgaacggtaccgtaccggtaaccggttacccgtacggtaccgacgacccggtacggcctaccggtcccccgtcggtacccaccgtttcccgttacccgttccccacccccgttccttcccgtcc

SEQ ID NO: 70185 - DNA, 680 bp, Homo sapiens
  misc_feature: GYAE6OF01AN1AN.49.26.C04.1.454.CMB.1.raw
  modified_base (245)..(245): a, c, t, g, unknown or other
  misc_feature (245)..(245): n is a, c, g, or t
  modified_base (334)..(334): a, c, t, g, unknown or other
  misc_feature (334)..(334): n is a, c, g, or t
  modified_base (659)..(659): a, c, t, g, unknown or other
  misc_feature (659)..(659): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtcgtccccaggacaaacggccaggactaacctgctcgtggagatgcattgaaccaaaaaaatntgtctttgttggtaccagaagaagtcaggccaggcccggtgttcgctcatctatgacgacaacgaaaaccgcccgtcgggtactcccgngagagattctctcggtctcccaccgtcgacgggaccacgtcggaccacgttcgaacttcgtacgacgggccgggggtcccgtagggtcgggaaggtacgtagggaacggttacgaacgttacttaggtttacgttaccaccgtaaccgacgaaccctaacgtaagtaacgaaaactcgaaacgaggaagttaagtacgttcggggacgggtacggaacgacgtcgtacggacccgtcgtaaggtcccaaccggacccggtaaggtccctcccggaccccccgttacgggtaccctaccccgttccgttcccggttaacccccccnccgtttccccgtcgtttaccc

SEQ ID NO: 70186 - DNA, 694 bp, Homo sapiens
  misc_feature: GYAE6OF01B1J6X.49.26.C04.1.454.CMB.1.raw
  modified_base (243)..(243): a, c, t, g, unknown or other
  misc_feature (243)..(243): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagcccaccctcggtgtcggtgtccccaggacaaacggccaggataacctgctctggagatgcattgaaccaaaaaaatntagtctttggttggtaccaagaagaagtcaggccacgggccccggttgttcgctcatctatgacgacaagaaaaccgaccccgtccgggactcccgtagacgagtattctcgtcgcctccacctcgacgggaccagtcggacctacgttgactatcgacgggccggggcccgagggtacgggaggtagtgggaaggtcgtaactacgtttagtttacgttaactccaaccgacgaacctaaccgtaagtaagaaactacaacgaaggtaaggtaaattacggttccgggaacgggtaacgggaaccaaggtccgtacggaacccgttccgtaacgggtaccaaccggacccgtaacgggtccctaccccggtcccccccgttacgggttaccctacccgtttcccgttaccccggttaccccctacccccgtttcccttcccgttaccccg

SEQ ID NO: 70187 - DNA, 641 bp, Homo sapiens
  misc_feature: GYAE6OF01E35PU.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacaagaaaaccgacccctccgggactcccgtggagagtattcctctcgggcctccacctcgacggggaccagtcggccctacggttcgaactatacgaggccggggacccgtagggtcgggagggtagtaggaagggtgtaacttaacgttagttttacgttaacctcaacccaagaaccaaccagtaagaaaactcaacaggaaggaattacggttacgggaccgggtaagggaaccaagcgtacgacccgtccgtaggtacaccgacccgaacggctacccggcccccgttcggtacctacccgttccgtccgtttaccccccgcccttccctccgttcccg

SEQ ID NO: 70188 - DNA, 447 bp, Homo sapiens
  misc_feature: GYAE6OF01CW468.49.26.C04.1.454.CMB.1.raw
  modified_base (414)..(414): a, c, t, g, unknown or other
  misc_feature (414)..(414): n is a, c, g, or t
  modified_base (418)..(447): a, c, t, g, unknown or other
  misc_feature (418)..(447): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacaagaaaacgaccctccgggatccctgagagattctctggctccacctcagggaccatggccacgttgactatcgaggccggggcccaggtggaggatggaaggtgaactactattcgttactacaccagacacagtagaaatacacagagaatatcggcggaggacaaagctgaccgtcctaggtcacgcccaaggctgccccctggtcactctcgttccccgcctcctctcctcgtcgactctgtagccgggctgggaccgaaggcgacaatcggntagnnnnnnnnnnnnnnnnnnnnnnnnnnnnnn

SEQ ID NO: 70189 - DNA, 744 bp, Homo sapiens
  misc_feature: GYAE6OF01CPNKE.49.26.C04.1.454.CMB.1.raw
  modified_base (244)..(244): a, c, t, g, unknown or other
  misc_feature (244)..(244): n is a, c, g, or t
  modified_base (508)..(508): a, c, t, g, unknown or other
  misc_feature (508)..(508): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtgtcggtcgtccccaggacaaacggccaaggactaacctgctctggagatgcattgaaccaaaaaaatntgtcttgtagtacaagaagaagtcaggcacggcccggtgtcgctcatctatcgacgaacaacgaaacgaccccgtccggatacccgtagagagtacttctacgtggcctccgacctacgacgggaccagtcggacctacgttcgacttatacgacgggccgggacccgagggtagggacgggtataggaaggtatacgtaacttagttacgttaactccaaccgtaagaaccctaacggtaaagtaacgtaaaacgtccgaaanaagggtaaacggtaaacttaacggtttaccgggggaaacgggaccggggaaaccgttaaaccgaccggttaccgggaaaccccgtttaccggttaaccggggaccgtaacccggtaaacccccgaagggtccccgttaccccgggtcccccccgtttaccgggtaccccttaaacccgtttcccggtttacccccgttacccccgttaaccccttccccgttccccgtttaccccg

SEQ ID NO: 70190 - DNA, 813 bp, Homo sapiens
  misc_feature: GYAE6OF01DXUC6.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgcttaattttaaaaggtgtcagtgtgaagtgcagttggtggaatcgtggggagtcgtggtagagccgtggggggtccctgagactcctcctgtcgcagcctcgtggtattcattctttgatgtattatgccatgcctacgtggactccgtacgaacggtccggtaccggggggtaagggtcgtaggggtacggttcgggttccttcgtttacgttttaagtttaaggtttggggtagttgggttacgggttaactacccgtaaccttaactataggactacgtaccgttcgtagggtacgggtaaacgggttaccgtaacgtttacccaaccgtacttcccgtaaccgaacgtaaacgaaaccaaaaccgaaaggtaacccgaaaccggtaaaacccctttacccggttaacgttaacttccgttaacgtaactaaaacgttacgaaacttaacggttacctagggtaaggtacgggtaggaaccgggacccgtaaccccgttaccctttacgtaacccttaacgttacgggttaaccgtaaaggtaaaaacgttaccgggtttaaacccgggtacgtaaaacccccttaaacctttaaccccgtttttaaaggttttacccgaaacccgttacggtaacccgggg

SEQ ID NO: 70191 - DNA, 519 bp, Homo sapiens
  misc_feature: GYAE6OF01CUYR2.49.26.C04.1.454.CMB.1.raw
  modified_base (343)..(343): a, c, t, g, unknown or other
  misc_feature (343)..(343): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (497)..(497): a, c, t, g, unknown or other
  misc_feature (497)..(497): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctcctgtgcagcctctggattcatctttgatgattaatgccatgcacgtggatccgtcaagcgtccggggaaggtcgtggagtggtctctnttaattaagtggatggtgtatcactatatgnagctgtgtgaagggtcattcacntcctccaagacgacaaacagacaagaaacctcccgtagtactctagacaaatgaaacngtacngagagtgagcaccgcttcatctgacanaaatntacgnaccactactatttacgctgtcg

SEQ ID NO: 70192 - DNA, 722 bp, Homo sapiens
  misc_feature: GYAE6OF01A0HXR.49.26.C04.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctgganatgcattgaccaaaaaatntgcttgttgtacagaagaagtcaggccacggcccggtgtgctcatttatgacgacaacgaaaaccgcccgtaccgggactccctggagagtatttctacgtcggcctacccacctcgacgggaccagtcggcctacgttgaactatcgacgggccggggacccgaggggtcgggaagggtagtagggtaagggtacgtaacgttactttaagtttacggtttaacctacgaaaccgaacggaacctaacccgtaaggtaacgtaaaactccgaaagaacggaaggtaaacgttaggttaccggggacgggtaacggggtaaaccgaacggtaccgtacggacccgtttaccggaacgggttacgaaaccggtaccccgaaacgggttccctacccgggtacccccccgttcgggtacccctaaccgttcccgttacccggttccccccgtacccccttcccggttcccttcccgttaccccg

SEQ ID NO: 70193 - DNA, 748 bp, Homo sapiens
  misc_feature: GYAE6OF01C2NU6.49.26.C04.1.454.CMB.1.raw
  modified_base (736)..(736): a, c, t, g, unknown or other
  misc_feature (736)..(736): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagtcttgggttttccttgttgcttaattttaaaaggtgtccagtgtgaagtgcagttggtggaatcgtgggggagtcggtggtagaggccggtggggggtccctggacgtacctctccgtgtcgcagcctcgtggtattcattcgtttgagttgtaatttatcgacctagtcgactacgtggtacgtccgtacgaacggtccgggtaccgggggtaagggttcgtagggtagggttcggttcttctttacgttaagtttaaggttgggtagttggttacggtaacttccgtaaccttaacgtagtcgacgtaacgtccgttcgtaggtacgggtaacgggttacgtaactttacccgaacctagttacccaccgaaagggtaaccaaaccgaacgaacgtaacctaaacggtaaacccctttcccgttaagtaccttacgtaacgaactaacgtaacggtaactacggttaccgtaacggtaggtaacgggtacggaaccggaccctaccggttcctttaactacgtaccgtagacgaaactaaacgtacgttaaccggtacacccttacttaacttagttaacccnccgtctaccggg

SEQ ID NO: 70194 - DNA, 734 bp, Homo sapiens
  misc_feature: GYAE6OF01EGQXN.49.26.C04.1.454.CMB.1.raw
  modified_base (242)..(242): a, c, t, g, unknown or other
  misc_feature (242)..(242): n is a, c, g, or t
  modified_base (711)..(711): a, c, t, g, unknown or other
  misc_feature (711)..(711): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagcccaccctggtgtcggtcgtccccaggacaacggcaggataacctgctctggagatgcattagaaccaaaaaaatntgtctttggtacggtaaccaagaagaagtcaggtcccgacgggtccccggttgttcgctacatctagtgacgaacgaacgaaaaccgcccgtcgggactcccgtagacgagtacttcgtacgtcggccttacccgaccttccggaacggggtacccaggttccggacctaacggttcgtaacttcgtacggacgggcccggggacctaggggtgggaagggtagttagggtaacggtgtaaccgttaacgttagtttacgtaacctacaacccgaagtaacctaaccgtaggtaaacgaaaacttacgaacacgggtaaaggtaacgttaacggttaccgggacggggtaacgggaacctaacgggccgtaccgaaccgttcccggtaaggtaccgaccgcccggtacgggtcctacccggtcccccgtacgggtaccctaacccgggttccttaccccgttacccccnccccgtttccctccgttaccccg

SEQ ID NO: 70195 - DNA, 534 bp, Homo sapiens
  misc_feature: GYAE6OF01A4J6T.49.26.C04.1.454.CMB.1.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
  modified_base (523)..(523): a, c, t, g, unknown or other
  misc_feature (523)..(523): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctgganatgcattgaccaaaaaaatntgcttgttggtaccagaagagtcaggccaggccccggtgttgctcatctatgacgacagaaaaccgaccctccgggactccctgagagattctctggctccacctcgacgggaccagtcggccacgttgactatcgaggccggggcccagggtggaggactggaaggtgactactattgttactcacanacacagtanaaatcanagagaatagtcggacggaggacagctgaccgtcaggtcacgcccgaggctccgccccgtcgcctactcctcgtcccnccctcctctcc

SEQ ID NO: 70196 - DNA, 760 bp, Homo sapiens
  misc_feature: GYAE6OF01BFLBB.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgtcttaattttaaaaggtgtccagtgtgaagtgctagttggtggaatcgtgggggagtcgtggtagagccgtgggggtccctgagactctcctgtgcacgcctcgtggtattcattctttgatgtaattatgccatcgactacgtggtactccgtacgtaacggccggtaccgggggtaagggttccggtagggtaggttcggggttccttcgttacgttttaaagtttaaggttgggtaggttgggttaggttaacgttacctaacccgtttaacttaacgtcgtacgtaacgtaccgttcggttaggttacgggtaaacgggttcgtaactttacccaaccgtactccgtaaccgaaggaacgtaaaccaaacgcgaacctaacggtaaacccttcccgtaagttacctaccgtagaactaaagtacgaaacgtcgttaccgtacgaagggttacggtaggaaccgacccttaacccggttccctttaacggtaccttaaccgttggaaacggtaaactaaaacggttcgttaacgggactaacccctacgttaaccctttaggtttaccaaacccgtggtaccccgggg

SEQ ID NO: 70197 - DNA, 748 bp, Homo sapiens
  misc_feature: GYAE6OF01C1SEP.49.26.C04.1.454.CMB.1.raw
  modified_base (254)..(254): a, c, t, g, unknown or other
  misc_feature (254)..(254): n is a, c, g, or t
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggccctcctatgagctgacacagcccacccgtcggtgtcggtcgtccccaggacaaacggccaggataacctgctcgtaggagatgctattacgaaaccaaaaaaattntgtctttggttaggtaccaagaagagtcaggccgacggcccggttgtcgctcattctagtcgaacgaacgtaaacggaaacccgacccgtaccgggacttcccgaggacgtagtacttcgtccgtcggccctaccgtaccgtacggaacgggaccctacggtccggtaccgtaacggttcgaaccgttacgtccggacggggcccggggtacccgtaggggtagggaacggtaggtaacggtaaggtacgttaactaacgttagttttaccgtaacctaccgaaccaacgacctaaccgtaagtaacgtaaactcgaacgtaagggtaagtaacgtaggtaccgggagggtaacggacctaacggccgtacggacccgttacggtacggaccgtaaccgacccggaacggtcccctcccggtccccccggttacgttaccccgtaccgtttcccccgtaccgtttcccccctacccttcccttccgttaccccg

SEQ ID NO: 70198 - DNA, 714 bp, Homo sapiens
  misc_feature: GYAE6OF01BMD24.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctcctgtgcagcctctggtattcattctttgatgtattatcgccagtgctacgtggtactccgtacaacggtccggtacccgggggaaggtcgtgggaggttgggttccttcttacgtttaagtttaagttgggtagttggttggtacttacctaaccttacgtagtcgtacgaacgtctcgttaggtacggtaagggtccgtaactttccaacctatcctaaccgaaggtaacgaaaccgaaacgaggaccctaaacgaaaccccttcccgtagttactacgtacgaactaaacgtagaaacgttcgtacgacgtaaggtacggtacgaaccgtaccctaccccggttctttaccgaaacgttcttacggtaacgaaacgttaaacggtccggtttaaccgggaccctaacccgttaacctttacccgtttaaatttccccggaaccctgggtaccccggg

SEQ ID NO: 70199 - DNA, 534 bp, Homo sapiens
  misc_feature: GYAE6OF01B4M4U.49.26.C04.1.454.CMB.1.raw
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctctggattcatctttgatgattatgccatgcactggatccgtcaagcgtcggggaggtcgtggagtggtctctcttattatggatggtgtatcactatatgcagctcgtgtgagggtctattcactactcnccagacgacaacagacagaacctcctntatctagacaatgaactacgtctacgtagaggtgaacggaccacccgtccttactactacgtgtagacaaaggtcttacggtacacctactaccttatttcgacctgtccgg

SEQ ID NO: 70200 - DNA, 801 bp, Homo sapiens
  misc_feature: GYAE6OF01DKDE6.49.26.C04.1.454.CMB.1.raw
  modified_base (270)..(270): a, c, t, g, unknown or other
  misc_feature (270)..(270): n is a, c, g, or t
tcagagtcgagagacacgaccggtgctcgatttagtctagcgactttgggtttggggtgggctcaggaggcagagctctgggaatctcaccatggcctggaccctctcctgcctcccctcctctactttctgcacagtctctgacggcctcctatgagctgacacacgcccacccgtcggtcggtcggtcgtaccccgaaggaaccgaaaccggccgaaggaactaaccgtgacctcgtggagtatgactattacgaaacctaaaaaatntacgtcgtttaggttacggtaaccgaaggaaagaacgtacgacggaccgacggtcccggttgttacgcctacgactacgtagtacgacgaacgaaacggaaaacccgcccgtacgggtacctccgtaggaacgtacgtacttctcgtcggccctaccgtaccgtacggaccggaacctacggtaccggtaccgtacggtacgtaactaacggtacgaccggggccggggtaccgtaggggttacgggaagtagggtacggtaaacgggttacgtaacgttaacgtttagtttaccgttaaccaccgaaacgtacaccgtaaaccgtaagtaaacgaaactacggaagaagggtaacgtaacgttaacgggtccggggaacgggtaacgggaaccaagggtaccctacgggacccgttcggtaacggcccgtaacggaccccgtagggtcccctcccggtcccccggttacgtacccgtacccgttcccggtttaccccgttccccccggttcccttccgtccgttccccgg

SEQ ID NO: 70201 - DNA, 488 bp, Homo sapiens
  misc_feature: GYAE6OF01DCA77.49.26.C04.1.454.CMB.1.raw
  modified_base (242)..(242): a, c, t, g, unknown or other
  misc_feature (242)..(242): n is a, c, g, or t
  modified_base (465)..(488): a, c, t, g, unknown or other
  misc_feature (465)..(488): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaacgacccctccgggatccctgagagattctctggctccacctcagggaccatggccacgttgactatcgaggcggggcccagggtggaggatggaaggtnactactattgttactcacagacaccgaagtagaaaactcaacgagaaggaatagttcgggcggaagggaccagctcggacccgtcgtacggtcaccgacccgaaggcctaccggccccccttcgggtacccaccgttcctaccgttccccctaccccttcctcgtcctcccgtcgacctcgtggacggccggtcgtacggacgaacgggccacgtagtagcannnnnnnnnnnnnnnnnnnnnnnn

SEQ ID NO: 70202 - DNA, 663 bp, Homo sapiens
  misc_feature: GYAE6OF01A3DT6.49.26.C04.1.454.CMB.1.raw
  modified_base (490)..(490): a, c, t, g, unknown or other
  misc_feature (490)..(490): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgctattttaaaaggtgtccagtgtgaagtgcagttggtggaatcgtgggggagtcggtggtagagccgtggggggtccctggagactctcctggtgcagcctctggattcattctttgattgattatgccatgcactggactccgtacaagccgtaccgggggaaggtcgtgggagttcgggtctcttacttattaagttgggagtggtgtatcaccttatatgcagtactcgtggtaggaagggttctacttccgactactccaccgaagaacgaacaacagaccaacgtaaaccttcccgtagtactcctagaactaaancggtaaactacggttcctacgaagggtacgggtacgaacgggtaccctaacccggttccctttaccgtaaccgttaaccgttgggtaacgtaaacgtaaaaacggttcggtttaaacggaccctaaccctaacccttaacgtttaacgtttcgaaacccgttcggtacccggg

SEQ ID NO: 70203 - DNA, 838 bp, Homo sapiens
  misc_feature: GYAE6OF01C9ALR.49.26.C04.1.454.CMB.1.raw
  modified_base (245)..(245): a, c, t, g, unknown or other
  misc_feature (245)..(245): n is a, c, g, or t
  modified_base (293)..(293): a, c, t, g, unknown or other
  misc_feature (293)..(293): n is a, c, g, or t
  modified_base (421)..(421): a, c, t, g, unknown or other
  misc_feature (421)..(421): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctggtgtcggtgtccccagggacaaacggccaggactaacctgctcgtggagatgctattgaacctaaaaaaatntgacttggttacgtaccaagaaagagtcacggccacgggccccggttnttcggctacatctagtcgaacaaccgaagaaaaccggcccgtaccggggaactccccgtaggacgagtacttctcgtcgcctaccgaccttcgaacgggaccagtcggcctacggttacgacttaacncgtaacgggcccggggaccctagggtacgggaagggtacgtaacgggtaacgggtacgtaaccgtttaaacgttaaacggttttcgttaaaccttacccgaacccgttaacggaaaccctaacccggtaaacggtaaggtaaaaacccttccgaaacggtaaacggtaaacggggtaaaactttacccgggtttaaccggggaccgggggtaacgggtaaaccccggaacgggttacccggtaacgggtaaccccggtttacccgggttaaggaccccgttaaccggggaaaccccggtaaaccggggtcccgttacccccgggtccccccggttaaacggggttcccccaaacccggttttcccgttaccccggtttaaccccccttcccccgttacccgtttccccgttcccccg

SEQ ID NO: 70204 - DNA, 897 bp, Homo sapiens
  misc_feature: GYAE6OF01B2XXJ.49.26.C04.1.454.CMB.1.raw
  modified_base (250)..(250): a, c, t, g, unknown or other
  misc_feature (250)..(250): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccacccgtcggtgtcggtcgtccccgaggacaaacggccaggactaacctgctcgtggagatgctattagaacctaaaaaaatntgtcttggtagtaacagaagagtcgacggccgacggcccggttgttcgctacacgtctagtacggaaccgaacgaaacggaaaacccgtccccgtacgggactcccgtagaacggattacttaccgtcgtcggtcctacccaccgtacgaaccgggtacctacggtccggacctaacggttacgaacgtacgtaccggacgggacccgggggtacccaagggggtacgggaagggtaacgttacggggtaaacgggttcgttaaaccgtttaacgtttaaggttttaccggttaaaccctaccggtaaacccgtaaacggtaacccgtaaacccgtaaacgggttaaaacgtaaaaccgttacccgaaaacgggaacgggttaaagggtaaaaccgttttaacggggttacccggggggaaaccggggttaaacccgggggaaacccgtaaacgggttccgttaaccgggtaaccccggttaccggttaaccggggtacccgaaaacccgggtaccccgggtaaaccgggtccccgttaccccccgggttcccccccgtacggggttacccctaacccccggtttcccggtttacccccggttaccccccgttacccccgtttccccggttcccgtttaccccccgg

SEQ ID NO: 70205 - DNA, 812 bp, Homo sapiens
  misc_feature: GYAE6OF01B4H7A.49.26.C04.1.454.CMB.1.raw
  modified_base (171)..(171): a, c, t, g, unknown or other
  misc_feature (171)..(171): n is a, c, g, or t
  modified_base (240)..(240): a, c, t, g, unknown or other
  misc_feature (240)..(240): n is a, c, g, or t
  modified_base (635)..(635): a, c, t, g, unknown or other
  misc_feature (635)..(635): n is a, c, g, or t
tcagagtcgagagacacgaccggtgctcgatttagtctagcgactttggggtttgggggtgggctcaggaggcagagctctgggaatctcaccatggcctggacccctctcctgcctcccccctcctcacctttctgcacagtctctgaggccctcctatgagctgacacncgcccacccgtcggtggtccggtcgtccccgaggacacggacggccaggatccacctgcctcgtggganagtgactattacgaacccaaaaagtatagtcgtactttaagttcggtaaccagaccgaagggaacggcccggggaccaccgggtccccgttgggttcggtttgggtagtaagttaggtaaaagtaaaacggtacctaacggtaggaaacggtaccggtaccctacgggacgggtaaccttaccccggtggaaacggtccggttaactttccggttaccggtcggtcccgttacccggaacggggtacccgaaaggggtaacccgtaaaccgggtaccaaacgttacgttacgggaccctaagtaccggagggtcgggtaacgaccggtagggaccgaagggtacggggaacgtacggacgttaggtaacctttagttaacttcggtaactaaacncgaaacaacgtcctaaacgtagtttacgtaacctttagtacggttcctaggaaccgttcggaacgtaaacccggtacggtaccgttacccggtcggtagggtcccctaaaccggacccggtaaaccccggaacctaacccccgtacttacgtcctaacccgttcccggttacccccg

SEQ ID NO: 70206 - DNA, 677 bp, Homo sapiens
  misc_feature: GYAE6OF01C9TJ7.49.26.C04.1.454.CMB.1.raw
tcagagtcgagagacacgaccggtgctcgatttagtctagcgactttgggtttggggtgggctcaggaggcagagctctgggaatctcaccatggcctggaccctctcctgctccccctcctcactctctgcacagactctgaggcctcctatgagctgacacagcccaccctggtgtctgtgtcctcaggacagacggccagtatcacctgctctggagatgcattgaccaaagcaatatgcttacgtggtaccagcaagaacgccaggccacgcccctgtctgatctatttaataagtactttgagacgggcctcgacgggaccctgacgcgtattctcgtggcctcgagtcctacgacgccgtaacaaccgtagtaccgtacgtttacgaacccagttacgtaacggtggggaacggttcccggggataaagggacgggaaccgggaagggtccgttagtaaccgtttaacgtttacgtacgttactaacggtctaacgtacgaaacggtaccgtaaggttacgggttggacccttaacgtttccgttagggttaccgtttaacggttcccgggggtaaccggggacggggtaaacccgtaagggtcccgttaacggtacccccgggtttacgtacgggttaccgaacccggtccccggtaaagggtccccccg

SEQ ID NO: 70207 - DNA, 833 bp, Homo sapiens
  misc_feature: GYAE6OF01DIPMO.49.26.C04.1.454.CMB.1.raw
  modified_base (243)..(243): a, c, t, g, unknown or other
  misc_feature (243)..(243): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtcgtccccaggacaaacggccaggataactgctcgtggagatgcattagaaccaaaaaatntagtcttaggttcggtaccagacaaggaacggccgggaccgacggtcccctggtcggttggtgtatagtaataaacgacacgtggagcggacctgagggtactcccgtagacgtcgtacttcgtcgtggcctcgacggtacgacgggaccaacgggtcacgtagttcggacctagtacgtaggtcggaacggtccgaagggtacgaagggaacgggtaccgggaggtacccgtaagggttaactttaacgttttaaggttaccggttaaactaaacgtacccgtaaaaccggtaacgtaaccccgtaacgttaaacgttttacgggtttaaaccgttttaacgttccgggtttacccggttttaaccgggtaaaccgttaccgggttaaaccccggtaaaccgggttaaacccgggtacccgttaaccccgggtttacccccgggtttaagggggtaaccccctaacccggggaaccccccgggtaaaacccggggccccccctaaacccccggttacgttaacccgttacccgttacccgtttacccccgtttaccccgtttaccccccgtaaccccccttttccccgg

SEQ ID NO: 70208 - DNA, 711 bp, Homo sapiens
  misc_feature: GYAE6OF01CLC51.49.26.C04.1.454.CMB.1.raw
  modified_base (133)..(133): a, c, t, g, unknown or other
  misc_feature (133)..(133): n is a, c, g, or t
  modified_base (215)..(215): a, c, t, g, unknown or other
  misc_feature (215)..(215): n is a, c, g, or t
  modified_base (376)..(376): a, c, t, g, unknown or other
  misc_feature (376)..(376): n is a, c, g, or t
  modified_base (469)..(469): a, c, t, g, unknown or other
  misc_feature (469)..(469): n is a, c, g, or t
  modified_base (509)..(509): a, c, t, g, unknown or other
  misc_feature (509)..(509): n is a, c, g, or t
tcagagtcgagagacacgaccggtgctcgatttagtctagcgactttggggtttggggtgggctcaggaggcagagctctgggaatctcaccatggcctggacccctctcctgcctccccctctctactttcngcacagtctctgacgtcctctatgacgctgacacacgccctaccgtggtctctgtctcctagagcaggcgcagtactcactncctgtggatatgactagtcgaaccaaagctaatgtcgtacttacgtcggtaacagacgaaggacgaccgacgacgtaccggtccctggttcctagtacttacgttaaatttaataaaggttacgtttaggacggtaacggtcctacggaaccggtaacccnggtaactcgtactcgtcgtcgtacctcacgtacacgacaccgaagtaccgagtactaacgtcaacctagcggtaaggtcggacggtcccgganaagggcggacgtacgtactagtaaacgtttcgtacgtttnaacgtaacttcaacgtaccgaacgttaacggtaggtttcgggactttaaccgttcttagggttaccgttaaccggtagggtttacccggggacggggtaaacgttaacccggtacggtaaccggttaccgggtaacccccgtttaacgggtccgtaaaccccgcccgggttaaaccggtccggttcccccgtaacccccggg

SEQ ID NO: 70209 - DNA, 792 bp, Homo sapiens
  misc_feature: GYAE6OF01AHJTZ.49.26.C04.1.454.CMB.1.raw
  modified_base (267)..(267): a, c, t, g, unknown or other
  misc_feature (267)..(267): n is a, c, g, or t
  modified_base (338)..(338): a, c, t, g, unknown or other
  misc_feature (338)..(338): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctcctgtgcagcctntggattcattctttgattgattatcgccatgcacgtgactccgtacaaggtccgtaccgggggaaggtcgngggtaggtcgggtctcttacgttaatttaaggtggtagtggttaggtactactacctactatcgctagtaccttcgttaggtggtaacggggttaccgtatttacccgaaccctattacccgtaccgaacggtaacgaaaccctaaaacggacgtaacccaaacggttaaaccccgttccccgttaggttaacttaccttacggaaaccttaaaacgttaccggaaactaaccggttccttaaccgggaagggtaacggggttacgaaaccgggtaaccccaaccccgggtttaccctttaccggttaaacccctttaacggttacgggttaacgtaaaaccccgaaaaagggtttaccgtttaaaaaccccgggggtctaaaacccccgtaacccgttaaaccgtttttaaccgtttttaacggaaaccccccgtttaggtaacccccggggg

SEQ ID NO: 70210 - DNA, 626 bp, Homo sapiens
  misc_feature: GYAE6OF01BDHR7.49.26.C04.1.454.CMB.1.raw
  modified_base (509)..(509): a, c, t, g, unknown or other
  misc_feature (509)..(509): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctctggattcattctttgattgattatgccatgcactggatccgtcaagcgtccggggaggtctgggagtgggtctctcttagttagttggagttggtggtacctactactatgcagactcgtgtggaagggtctattcacctatcctaccgaagacgacaaacaggaccaagaaaccttccgtagtactcgtagaactaaatcgaaactggtacctacggaaggtacgggtaggaccggtaaccncccgttaccctttactaccttacgtacggtacgaaaccgtaaaaggtacgttaccgggtacaaacccctacttaaccgtttaacttttaccggaacccgttacgtcgggtaccccgg

SEQ ID NO: 70211 - DNA, 705 bp, Homo sapiens
  misc_feature: GYAE6OF01CQOTO.49.26.C04.1.454.CMB.1.raw
tcagagtcgagagacacgaccggtgctcgatttagtctagcgacttttgggtttggggtgggctcaggaggcagagctctgggaatctcaccatggcctggacccctctcctgctccccctcctcactttctgcacagtctctgaggcctcctatgagctgacacagccaccctcggtgtcggtcgtccccaggacaaacggccaggactaacctgccttcgtggagatgctattcgaccaaaccgtatagtgactttagttcggtaccagcaaggaacggccggggccacgggtccccttggtggttggtagagttagtaataaaaggtaccaacgtggaacggacggcccctacggaacgggacttccccgtaggacggtacgtatttccgtacgtcggtcctaccgacgggtacggacgggtaaccgtaacggtccacgtagttcggacctagtcaaggtcggacgtccgagggacagggacggacggacggtcgtagtacgttatttagttacgtactaactacaacgacgaaccaccgttagtttcggttaactttagtacgttcgttaccggtaactcggacgtaaccgtaggtcccgtaccgggttcgtacgggtaccgaccggtaccccgacggaccccctaaccccgtacgttaccgtaccctccgttacccgttccccgttccccggttaccccc

SEQ ID NO: 70212 - DNA, 905 bp, Homo sapiens
  misc_feature: GYAE6OF01DFTHI.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctctatgagctagacacacgtccaccctcgctgtcagtccgtacccgaggaccaaacggccgaggactccaccgtcgtctcgtggaagatgtactagttacgaaaccgtaaaaagtatattacggttactttagttacggtaacctataaccgtaaggtaaacggtccgaaccgggtaccccgtaaccgggtcccccgttaggttaccgttagggttacctaacgtttacgttaacggtacggaaaccggtaacccgaaaaccccggaaaaccccggttaccccggtaaccgggtaacccttacccccgtaacggtaacttacgtttccgtaccggttacgtccgttaaccggttaacgggttaacggaccgttacgggtacccggtaccctaaccggtacgtaccgacggttaccggtacggggtaccggggtaccccgggtaggggtaccgggtaagggtacggttaggggtaacgggttaacgttaacgtttaaccgtttacgtttacgttaaccgtacgtaaaccggtaacgtaaacgtttaactttaactttaacctaccgttaacggtttaacgggttacgggttaccgggtaccggggtaccggggtaaccgggtaaccgtacggtaccggtaccggtaccggttaccggtaccggttaccgacccggtaccgtaccgggtaccctccccggtaccccgttaccgtaccgttcccttacccgttccccgtacccccttcccgtccttccccg

SEQ ID NO: 70213 - DNA, 631 bp, Homo sapiens
  misc_feature: GYAE6OF01CB58E.49.26.C04.1.454.CMB.1.raw
  modified_base (453)..(453): a, c, t, g, unknown or other
  misc_feature (453)..(453): n is a, c, g, or t
tcagagtcgagagacacgaccggtgctcgatttagtctagcgactttgggtttgggggctctggggaaaggagccccagccctgagattcccaggtgtttccattcggtgatcagcactgaacacagaactcaccatggagtttgggctgagcttgggttttccttgttgctattttaaaaggtgtccagtgtgaagtgcagttggtggaatcgtgggggagtcgtggtagagccgtggggggtccctgagactctcctggtgcagcctctggattcattcttttgatgtattatgccattgcactgggtactcccgtacaacggtccggtaccgggggaagggtccgtgggaggttcgggtcttcttacttaattaagttgggagttgggtggtactctacctactagtgcagtctcgtggtggaagggttctattcacctatctacgaganacaacagacaacgtaaccttcccgtagttactactacgtaactaaagtcgaaacgtgttaccacggaaggtagggtacgacggaccctaccgtccttactaccgtacgtggtacgtaactaaaaggttcgttaacggtccaaccctaccttactttaccgtttcgaccgtcgtaccgg

SEQ ID NO: 70214 - DNA, 791 bp, Homo sapiens
  misc_feature: GYAE6OF01EYCKY.49.26.C04.1.454.CMB.1.raw
  modified_base (251)..(251): a, c, t, g, unknown or other
  misc_feature (251)..(251): n is a, c, g, or t
tcagagtcgagagacacgaccggtgctcgatttagtctagcgactttgggtttggggtgggctcaggaggcagagctctgggaatctcaccatggcctggaccctctcctgcctcccctcctcactttctgcacagtctctgagcctctatgagctgacacacgccacccgtcggtcgtcggtccgtcccgaggaacaacggccaggactaacctgctctaggagatgctattacgaaacctaaaaaagtntagtcgtttaggttacggtaaccgaagaaaggtaacgtaccgacgggacccgtaaccgggtccccggttgtcgtcctactagttactagtacgaccggtaacgaaacggtaaaacccgtaccccggtcggtacctaccggtaggaacgtagttacgttctacgtcgacctacccgtaccgtaacggacgggtacctacggtcggtaccgtacggttaccgtaacgtacgtacggacgggaccgggggacccgtaaggggtcggggtaagtggttaaacgggtaacggttcgtaaacccgttttaacggtttaacgtttacccgtaaccgttacctaaaccgacgtaaccctaaaccggtagttaaacggtaaaactccggaaagtaacggtaagggttaacttacggggtaacccggggaggtaaaccgggaacgaccgtgtacccggacggtacggtacgaccgaccgaccggtacgcgtacccggtccccgtgtccttaccgtccgttacccgttacccctccctcctcgttaccccg

SEQ ID NO: 70215 - DNA, 751 bp, Homo sapiens
  misc_feature: GYAE6OF01CVRDY.49.26.C04.1.454.CMB.1.raw
tcagagtcgagagacacgaccggtgctcgatttagtctagcgactttgggtttgggggctctgggaaaggagcccccagccctgagattcccaggtttttccattcggtgatcagcactgaacacagaactcaccatggagtttgggctgagctgggttttccttgttgctattttaaaaggtgtccagtgtgaagtgcagttggtggaatcgtggggatcggtggtagagccgtgggggtccctgagtactctcctgtgcacgcctcgtggtattcattctttagatgtattatgccatgcacgtggacttccggtacaacggtccggtaaccgggggaagggttccgtaggggtggttcgggttcctttctttcgttttaagtttaaggttggggtagtttggggttacgttaacgtaccctaaccgttaacgttatcggtaccagtactcggtagtaggtaacgggtctatcccaaccgtactccgtaccaagtaacgaacacgaacgtacgaacgtaacctcccttagtactacgtacgaactaaactcgtaacgtgttaccgtaggaagggtaggttaacgaccggtaaccccgtacccgttaacccgttacccttaacgttaaccgttacgtaacggtaaaccggtaaaacgtttaccggttaaaccgggaaccctaaacccgtacccttaaaacctttttacgttaccggtaaacccgtccgggttaccggtaaacccccgggg

SEQ ID NO: 70216 - DNA, 406 bp, Homo sapiens
  misc_feature: GYAE6OF01B8HR8.49.26.C04.1.454.CMB.1.raw
  modified_base (399)..(406): a, c, t, g, unknown or other
  misc_feature (399)..(406): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacacagtgaaaatcacagaggaatattcggcggagggaccaagctgaccgtcctaggttacgcccaaggctcgcccctcggtcactctcgtccccaccctcctctctctcgactctgacgcggctggcaaggcgacatagnnnnnnnn

SEQ ID NO: 70217 - DNA, 694 bp, Homo sapiens
  misc_feature: GYAE6OF01AOR2O.49.26.C04.1.454.CMB.1.raw
tcagagtcgagagacacgaccggtgctcgatttagtctagcgactttgggtttggggggaaggaggaagactgacggtccccccacggagttcaggtgctgggcacggtgggcatgtgtgagttttgtcacaagatttgggctcaactctcttgtccaccttggtgttgctgagctgggttttccttgttgcttatttaaaggtgtccagtgtgaagtgcagttggtggaatcgtgggggagtcgtggtagagccgtgggggtccctgagactctcctgtgcagcctctggattcattctttgatgtattatcgcctagtcgactacgtcggtactccggtacgaacggtccggtacccgggggaagggttcgtaggggtacggttcgggttaccttcgttacgtttaagtttaggttgggtagtttagggtaggttactaccgtactactacgtgaccgtagtacttcgtaggtacgggaacgggttcctattcccgaactacgttcccgtacgaagacgtaaccaacgacggacctaaacgtaaacccttccgtagtaactcgtaacgataaacgtgaaacgtcgtactaacggaggacggttacgaaccggtacccgaccccgttctttacgtaaccttacggtagaaccgttaacgaaaacggttcgtaaccggtacaaccccgttaacg

SEQ ID NO: 70218 - DNA, 679 bp, Homo sapiens
  misc_feature: GYAE6OF01A1DVP.49.26.C04.1.454.CMB.1.raw
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagcccaccctcggtgtcggtcgtccccaggacaaacggccaggactaacctgctcgtggagatgcattcgaaccaaaaaattgcttgttgtaccagaagaagtcaggccacggcccggtgttgctcgatctatgacgacagaaaaccgccgtccggatccctggagagattctctcggcctccacctcgacgggaccagtcggcctagttcgactatcgacggtccggggacccagggtcgggaaggtacgtagggtaaggtcgacgttaacttagtttacgttaacctaccaaccagaaccaaccaagtaacgaaactcaacgtaaggaacggtaacttaagggttccgggacggggtaacgggaaccaaggtaccgtacggaccccgttacgtaccgggtacaaccgggaaccccgtaacgggcccgtacccggtccccccgttacgggttacccaacccggtttccgttacccggtttccccccgttaccccccttccgttccccgttacccg

SEQ ID NO: 70219 - DNA, 762 bp, Homo sapiens
  misc_feature: GYAE6OF01AYAF2.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgttggtaccagaagaagtcaggccaggccccggtgttcgctcatctatcgacgaacaagaaaaccgacccgtccgggactcccgtggaagagtattctacgtcggcctaccgacctacgacgggtaccagtcggaccctacgttgactagtccgacggtccggggacccgtagggtagggaaggacgtagggaagggtacgtaacgttacgttaagtttacggttaaccttaccgaacccgtaacgaaccgtaaccgaacggttaacgaaaaacgttcgaaaccgtaacgggtaagggtaaaacgttacggtttaccgggggaaccggggtaaacggggtaaccctaaacgggtccgttaaccgggtaccccggtttaacccggtaacgggttacccaaaccgggtaccccggaaacgggtcccctacccgggtacccccccgttacgggtacccttaacccggttcccgttacccggtttaccccccaccccgtttccccgttcccgtttaccccg

SEQ ID NO: 70220 - DNA, 780 bp, Homo sapiens
  misc_feature: GYAE6OF01DY4NM.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttggctcaactctcttgtccaccttggtgttgctgagcgttgggttttccttgttgcttaattttaaaaggtgtccagtgtgaagtgctagttggtggaatcggtggggagtcgtggtagacgcggtgggggtccctgagactctccgtgtgcacgtcctcgtggtacttctattctttgatagtattagtcgacctagtcgactacgtggtacgtccgtacgacggtccgggtaccggggaagggttcgtagggtacgggtcgggttccttacgttacgtttaagttaaggttagggtagttagggttagttacttaccgtaacccttatacgtacgacgtacgtactttggtggttaacggtaacgggttctacttcccaacgtcttccgaacgaggaacaaccaacgtacgaaccgtaaccgttaaacccttcccggttaagtaaccgtctaaacgtaaaccgtaaaagtaccggtaaaccttggtttaaccccggaggtaaaaggggtacccgggtaccgggaaacccgttacccccgttaaccccggtttccctttaacgttaacccgggttaacgtacggttaaacgaaaacccgtttaaagggaaccccgttttacggaacccaacccgtttaaacccg

SEQ ID NO: 70221 - DNA, 758 bp, Homo sapiens
  misc_feature: GYAE6OF01AQTG1.49.26.C04.1.454.CMB.1.raw
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtcgtccccaggacaaacggccaggataacctgctctggagatgctattagaaccaaaaaatntgtcgtttggttggtaccagaagaagtcaggccacggcccggtgttgctnatctatgacgacgaacgaaaccgcccgtacggactcccgtgacgagtacttcctacgtcggtcctacccgtaccgtacggacgggtaccctaggtccggtaccctacggttacgaacttacgtaccggacgggtacccggggtacccgtaaggggtacgggaagggtacgtaagggtaacgggttacgtaaccgtttaacgttaagttttacggtaacctaccgtaaccgtacgtaaccctaaccgtaacggttaaacgaaaacctcgaacgtaaagggtaacggtaagttaaccgggttaccggggaaccggggtaaccgggaacctaacgggtaccgttaccgggtacccggttaccgtacgggtaaccaccggacccgtaacggtcccgtacccggtcccccgttacgggtactacccgttccgttacccgttaccccccgtcccttcccgtccgttcccg

SEQ ID NO: 70222 - DNA, 662 bp, Homo sapiens
  misc_feature: GYAE6OF01BTAPN.49.26.C04.1.454.CMB.1.raw
  modified_base (245)..(245): a, c, t, g, unknown or other
  misc_feature (245)..(245): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtcgtccccaggacaacggccaggataacctgctcgtggagatgctattagaaaccaaaaaaatntgtcttggttacggtacaagaagaagtcgacggccgacggcccggttgtcgctctatctatagacgaacaacgaaaccgacccgtaccgggtactccgagacgagtacttcgtcgtcggcctccgaccgtacgacggacctagtcggacctacgttacgactacgtacggacgggccgggtaccgagggtagggagtagtaggtaaggtcgtaacttacgtttagttacgtactacgaacgacgtactaacgtaaggtaactaactacgaacgtaggaagtaacgtacggtacggaacgggacggacgtacgaccgtacggtaccgtacgtacggtacgaccggtacgaccggtccgtccccggtcccgtccgtacctcccttccgttcccgtcccccgtccccttccctcgtaccc

SEQ ID NO: 70223 - DNA, 741 bp, Homo sapiens
  misc_feature: GYAE6OF01AGT6G.49.26.C04.1.454.CMB.1.raw
  modified_base (246)..(246): a, c, t, g, unknown or other
  misc_feature (246)..(246): n is a, c, g, or t
tcagagtcgagagacacgaccggtgctcgatttagtctagcgactttgggtttgggggtgggctcaggaggcagagctctgggaagtctcaccatggcctcggaccctcctcctgctccccctcctcactttctgcacagtctctgaggcctcctatgagctgacacacgccaccctcggtgtcggtcgtcccaggacaacggccaggactaacctgctctggagatgcattagaaccaaaaaatntgtcgtttggttacggtaccaagaagaagtcgacggccgacgggccccggtagttcgctcactctatacggaacgaacgaacggaaaaccgtacccgtaccggtactcccgtaggagtagtcttcctcgtcggtcctcccaccgtccgaacgggtaccacgtcggaccgtacggtcgtacgtacgtacgacgggccggggacccggtaggtacgggagtagtaggtaaggtcgtaactacttagttacgttaacctacgaaccagtaaccgaactaagggtaactaaacgtcgaaacgaacggtaaggttaaacgttaacgggttaccggggacgggtaaacgggaccgtaacgtaccgtaccggtaacccggtacgtacggaccgaaccggtacccggtaaccggtcccgtaccccggtaccccggttaccgtaccccttaaccgttccccgtttaccccttaccccccttcccgtttcccttcccgttacccg

SEQ ID NO: 70224 - DNA, 698 bp, Homo sapiens
  misc_feature: GYAE6OF01BD1CZ.49.26.C04.1.454.CMB.1.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
tcagagtcgagagacacgaccggtgctcgatttagtctagcgactttgggtttggggtgggctcacgaggcagagctctgggaatctcaccatggcctggacccctctcctgctccccctcctcactttctgcacagtctctgaggcctcctatgagctgacacagccaccctcggtgtcggtcgtccccaggacaacggccaggataacctgctctgganatgcattagaaccaaaaaaatntagtctttgttacggtaccaggaagaagtcaggcccgacgggtccccggtgttcgctcatctatgacgacagaaaaccgccgtcggactccgtgagagtattcgtcgtcggcctccgacctcgacggaccagtcggacctacggttacgacttacgtcgacgggcccggggaccgagggtgggaacggtagtacgggtaaggttacgtaaccgttaacgtttaacgtttacgttaaccgtaccaaaccgacgaacccaaccgtaacgtaacgaaactacaacgaaggtaacggtaacgttacggtaccgggaccgggtaacgggaaccgtaacggccgtacggtacccggttccggtaacggtaccgtaaccgacccggaacggtccgtacccggtcccccgtaccggtacctccgttccttacccgtacccctaccccgttcctcccgttcccg

SEQ ID NO: 70225 - DNA, 415 bp, Homo sapiens
  misc_feature: GYAE6OF01BI8WJ.49.26.C04.1.454.CMB.1.raw
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (401)..(415): a, c, t, g, unknown or other
  misc_feature (401)..(415): n is a, c, g, or t
tcagagtcgagagacacgaccggtgctcgatttagtctagcgactttggggtttggggagatgcattgccaaaaaaatatgcttgttggtaccagaagaagtcaggccaggccccggtgttgctcatctatgacgacagaaaacgaccctccgggatccctgagagattctctggctccacctcgagggaccatcggccacgttgactatcaggcggggcccaggtggaggatgaaggtgactactattgtactcaccagacacagtagaaatcacagaggaatatcggcggaggaccagctgaccgtcgtaggtcagcccgaaggctcgccccgtgtccactctcgttcccaccctcctctctcncactntcgagcggctaggcgaaggcgacatacgcnnnnnnnnnnnnnnn

SEQ ID NO: 70226 - DNA, 742 bp, Homo sapiens
  misc_feature: GYAE6OF01AOBC3.49.26.C04.1.454.CMB.1.raw
  modified_base (246)..(246): a, c, t, g, unknown or other
  misc_feature (246)..(246): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagtctgacacagccaccctcggtgtccggtgtccccaggacaaacggccaggataacctgctcgtggagatgcattacgaaccaaaaaatntgtctttggttaggtaccaagaacgagtacgacggccgacgggtcccggttgttcgctacattactacgtcggaaccgtaacgaaacgtaaaaacccgtaccccgtccggggtaacctttacccggtaggaacgtaacgtacttcgttccgtcgggtaccctacccgacccgttaccggaacgggtaacccaaggttccgggacccttaacggttaccgaacttacgtaccggacggggtacccgggggacccgtaagggtacgggagggtaagtagggtaacggtacgtaacgtaacgtttagttacgttacctaccgtaaccgaacgtaccaaccgtaagtaacaaactacaagaaagtaaggtaacgttaagtccggggaagggtaacgggaacacggtacgtacgaccgtacgtcggtaccgacgacccggagtcccgcccgtccccgtaccgtcctacgtcccgttccgtccccctcgtcccttccgtccc

SEQ ID NO: 70227 - DNA, 462 bp, Homo sapiens
  misc_feature: GYAE6OF01B09U3.49.26.C04.1.454.CMB.1.raw
  modified_base (290)..(290): a, c, t, g, unknown or other
  misc_feature (290)..(290): n is a, c, g, or t
  modified_base (427)..(427): a, c, t, g, unknown or other
  misc_feature (427)..(427): n is a, c, g, or t
  modified_base (431)..(462): a, c, t, g, unknown or other
  misc_feature (431)..(462): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaaacgaccctccgggatccctgagagattctctggctccacctcagggaccatggccacgttgactatcaggcggggcccaggtggagatgaaggtgactactattgttactcacagacaccagtgaaaatcaacagagaatattcggnggaggacaagctgaccgtccgtacggtcgacgacccaacggtccttcccccgtccggtcctactccttacgttccccgtcccttcctcctcctctcgaccgtctgcgcggtcgtggacgacgggtcgcgactggacncgtnnnnnnnnnnnnnnnnnnnnnnnnnnnnnnnn

SEQ ID NO: 70228 - DNA, 404 bp, Homo sapiens
  misc_feature: GYAE6OF01ESKX8.49.26.C04.1.454.CMB.1.raw
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
  modified_base (394)..(404): a, c, t, g, unknown or other
  misc_feature (394)..(404): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggcctccacctcagggaccatggccacgttgactatcagcggggccaggtggaggatgaaggtgactactattgtactcacagacacagtagaaatcacagagaatatcggaggaggaccaagctgaccgtccgtaggtcacgcccaaggctcgcccccgtcgtcactctcgtcccgccctctctctctcgctctgagcggtcnggacaaggcganatagcnnnnnnnnnnn

SEQ ID NO: 70229 - DNA, 643 bp, Homo sapiens
  misc_feature: GYAE6OF01B0N15.49.26.C04.1.454.CMB.1.raw
  modified_base (245)..(245): a, c, t, g, unknown or other
  misc_feature (245)..(245): n is a, c, g, or t
  modified_base (342)..(342): a, c, t, g, unknown or other
  misc_feature (342)..(342): n is a, c, g, or t
  modified_base (396)..(396): a, c, t, g, unknown or other
  misc_feature (396)..(396): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctactgaggcctcctatgagctgacacagccaccctcggtgtcggtgtccccaggacaaacggccaggataacctgactctggagatgctattagaaccaaaaaaatntagtctttagttggtaaccaagaagtaagtcgaggccaggcccggtgttcgctacatctatgaacgacaacgaaaaccgcccgtacgggactcccgngacgtagacttactcgagcctacacctgacgggaccagtcgctacgttgactancgaggccgggcctagggtggagtatggaagtcgacttaactagtttacgtaactacgaaccgacgaacctaacagtaagaaactcgaacgtaggaaagtaacgttaggtaccggaacgggtacggaacctaaggacgttacgacccggtacgtaacggtcgaaccgtccgtaaacggtactccggacccccgttgggaccctacccgttaccgtcccgtttaccccacccccgttctccgttacccg

SEQ ID NO: 70230 - DNA, 891 bp, Homo sapiens
  misc_feature: GYAE6OF01DF5S8.49.26.C04.1.454.CMB.1.raw
tcagagtcgagagacacgaccggtgctcgatttagtctagcgactttgggtttgggggctctgggaaaggagccccagccctgagattcccaggtgtttcccattcggtgatcagcactgaacacagaactcaccatggtagttggctgagtcgttgggttttccttgttgtacttaagttttaaaaggtgtaccagtgtagaagtgctaggttggtggaagtcggtgggggtagtcggtggtagacggtccggtcggggggtccctggacgtaccttcctcctggtgcacgtcccttcgtaggtacttactattctttagtagttagtaatttatcgtcctaagtcgacgtacgtacggtaccgtacccgtcgaacggtccgggtacccgggggtaacgggttcggttagggtaggttcgggttaccttaccgttagtttaaaggtttaaggttagggttaggttacggttaggttaacctaccgttaaccgttaacgttagtccggacgtaggtaccgttcggttaggtaacggggtaacggttacgttaacttcccgaaccgtacgttacccgtacgaaacggaacgtaaacccgaaacgacgtaaacccggaaaccttaaaccccgttaccgtacgttaactacgttaacgaaccgtaaaactccggtaaacgtacgttaccgacgtaaccgggtagggtaacgaacccggtacccccgttaccgttaacccgtttaaccctaaacgttaaccgggttacgtaaaccggtaaaaggttaaaaacgggttaaccccggttaacccgggttaaaccccgaaacccttttaaacccgttaaaccccgttttaattacccccgggaaaccggttaaccggtaccccggggg

SEQ ID NO: 70231 - DNA, 762 bp, Homo sapiens
  misc_feature: GYAE6OF01BJ1WU.49.26.C04.1.454.CMB.1.raw
  modified_base (243)..(243): a, c, t, g, unknown or other
  misc_feature (243)..(243): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctggtgtcggtgtccccaggacaaacggccaggataacctgctcgtggagatgcattagaaccaaaaaaatntgtcttgttcgtaccagaagaagtcaggccacggtcccggtgtgctcatctagtcgacacgaagaaaaccgcccgtacggactcccgtaggaacgagtacgttcctacgtcggtccttcccgaccgttcgaacgggtaaccagtcggacccgtacgttacgaacttacgtaccgacgggtcccggggacccgaaggggtacgggaacgggtaagtacgggtaaagggtacgtaacgttaacgtttagtttacgttacctaccgaacccaacgtaaccaacgtaagtaacgtaaactacgtaacgaaggtaaggtaaagttaacggttaccggggaacggggtaaccgggtaaccggaacggtaaccgtaccgggtaacccggttacccggttaacgggtacccgaaccggtacccggtaaacgggtacccctacccgggttacccccccgtcgggttacccctaccggtttcccgtaccccgtttacccccggtcccctttccccgttccgttaccccg

SEQ ID NO: 70232 - DNA, 684 bp, Homo sapiens
  misc_feature: GYAE6OF01CTFBM.49.26.C04.1.454.CMB.1.raw
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
tcagagtcgagagacacgaccggtgctcgatttagtctagcgactttgggtttgggggaagaggaagactgaccggtccccccaggagttcaggtgctgggcacggtgggcatgtgtgagttttgtcacaagatttgggctcaactctcttgtccaccttggtgttgctgagcgttggtttccttgttgcttatttaaaaggtcgtccagtgtagaagtgcgtagttggtggaactcgtgggggagtcgtggtagacgccgtcgggggtccctgacgactctccgtgtcgcagtcctcgtggtattcattcttgatgtattagcgtccatgcctagtggtactcgtacgagtcgtaccgggaggtcgnggtagtcggtctcgtattaagttagtggtatggtgtactcgtaccttagntagtcaacgtacgtcgttaggtacggtaacgggttactactttaccgaaccgtactaccgtacggaaacgtacaaacgtaaaccgactaaccgtaaaacgtacccttacccgttaagttaccgccgttaacgaactaaacgtacgtaaccgttattccggacgtaaagggtccggtacgaacggaaccccgttacccgtccgtttaactaaccgtactacgggtaaacaaacggtaaaacgttccgtaacgtccgaaacccttaac

SEQ ID NO: 70233 - DNA, 695 bp, Homo sapiens
  misc_feature: GYAE6OF01DES4A.49.26.C04.1.454.CMB.1.raw
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (347)..(347): a, c, t, g, unknown or other
  misc_feature (347)..(347): n is a, c, g, or t
  modified_base (359)..(359): a, c, t, g, unknown or other
  misc_feature (359)..(359): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgcttattttaaaaggngtccagtgtgaagtgcagttggtggaatcgtgggggagtcggtggtagnggccgtggggggtccctgagactctcctgtgcagcctctggnttctagttctttgatgatttangccatgctactggactccgtacgaacggcgtaccgggggaaggtcgtggnggtcgggttctntcttaagttaagttggggattgggtgttaacgtcctaccgttactattggctaacgtacgttcgtggtacggtaagggttacgatttaccaccgacttccgtaccgaacgggaacaaccgaaacgtagaccaaaccgtaccttaccccgtagtacgttctacggtaactaaagtacgtaacgtacgtccttaacggaggtacgggacggtaaccggaccgtacccgttaccctttacgtaccttagtacggtaaccgtaaagtaaacggttacgttaaacgggtacgaaccctacttaaaccgtttacttttaccggaactaccgggttacccggg

SEQ ID NO: 70234 - DNA, 544 bp, Homo sapiens
  misc_feature: GYAE6OF01ANMHZ.49.26.C04.1.454.CMB.1.raw
  modified_base (494)..(494): a, c, t, g, unknown or other
  misc_feature (494)..(494): n is a, c, g, or t
  modified_base (505)..(505): a, c, t, g, unknown or other
  misc_feature (505)..(505): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctgggggggtccctgagactctcctgtgcagcctctggattcatctttgatgattatgccatgcactggatccgtcaagctccggggaggtctggagtgggtctctcttattaatgggatggtgtatcacctatatgcagactctgtgaagggtcattcaccatctccagagacaacagcaagaaactccctgtactctgacaaatgaacagtctcgagaggtagaggaccaccgtccttctacctacgtgtcgacaaaagtnttaaccgggtnaacccgtacctacccttattttacacccgtagtaccggg

SEQ ID NO: 70235 - DNA, 861 bp, Homo sapiens
  misc_feature: GYAE6OF01AQE62.49.26.C04.1.454.CMB.1.raw
  modified_base (208)..(208): a, c, t, g, unknown or other
  misc_feature (208)..(208): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
tcagagtcgagagacacgaccggtgctcgatttagtctagcgactttgggtttggggtgggctcaggaggcagagctctgggaatctcaccatggctggacccctctcctgctcccctcctcactttctgcacagtctctgagcctctatgagctgacacagccaccctcggtgtcggtgtccccaggacaaacggccaggataaccngctctaggagatgctattacgaaccaaaaaatntgcttggttaggtaccagaagaagtcgaggccgacggcccggttgtcncgtacacttctatcgaacgacgtaaacgaaaacccgacccgtcgggactacccgagtaggatattacgtcgtggcctacctaccgtacgaacgggaccagtcggacccgtaacgttacgaacttagtacccgaggggtcccggggaccccgtaaggggtacggggtaacgtacggttagggaaacgggttacgtaacgttaacgttaacgtttaacggttaacctaccctaaacccggaaccgtaaccgtaacccgtaaggttaaaggaaaaaccttccggaaaccaaagggtaacgggtaaaaccgtttaacgggtttaaccggggaaccgggggtaaacggggtaaacccgtaacgggtaccgtaaccgggtaaaccccgggttacccgttaaacggggtaccgaaaccccggggtaaccccgaaaaccgggtccccggttaccccgggtaaccccccccggttttacccggggtaaaccccgtttaacccccgttcccgggttttacccccccgtttaacccccccggttaaccccctttaaccccccgttttcccggttaaccccccg

SEQ ID NO: 70236 - DNA, 848 bp, Homo sapiens
  misc_feature: GYAE6OF01C4F5V.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctaattttaaaaggtgtccagtgtgaagtgcagttggtggaatcgtgggggagtcgtggtagagccgtggggggtccctgagactctcctgtgcagcctctggattctattcttttgattgtatttatcgccatcgcacgtggtactcccgtagaacggtccggtacccgggggaagggttcgtagggtacggttcggggttaccttctttaccgtttaagtttaaaggtttgggggtaagtttggggttacggttacttaccgtaaaccctttacgttaagtcggactaacgtaccgtttcggttacggttagggttaaacggggttccgttaactttaccccgaacccttacgttacccgttaccgaaggtaaacgaaaccaaaacgaacggaccgtaaaaccggtaaaaccccgttcccctttaaggtacttacccgttaaggaaacctaaaagtaacggtaaaccgtacggttaccgttaccgaagggttaaggggtacggaaaccggacccgttaaccccggttcccttttaacccgaacgtttaacccgttacggtaaccggtaaaaccgttaaaaacggtttaccggttaaacccgggtaactaaacccccgttaaacccgtttaaccctttaaccgttttaacccggaaccccgttaccgggttacccgggg

SEQ ID NO: 70237 - DNA, 917 bp, Homo sapiens
  misc_feature: GYAE6OF01DIIOH.49.26.C04.1.454.CMB.1.raw
  modified_base (130)..(130): a, c, t, g, unknown or other
  misc_feature (130)..(130): n is a, c, g, or t
tcagagtcgagagacacgaccggtgctcgatttagtctagcgactttgggtttggggtgggctcaggaggcagagctctgggaatctcaccatggcctggaccctctcctgcctcccctcctcactttcngcacagtctctgacgcctctagtgagctagacacacgcctaccgtcggtgtccggtacgtcccaaggacaacggcaacggtactaaccgtgcgtacgtaggtatactagtacctaattaacgaaaaccttaaaaagttcttcggttcgtttacggttaacggtaaccgaaaaggtaggtaacgtaccggacgggtaccccggtaacggtccccggtttggttaccgaccttacgtaacgttaacgttaccgtaaaccggtaaccgaaaccggtaaacccggtaaaaccccgggtacccggttacccgggttaaccttaacccggtaggtaacgttacgttaccttccggtaccgttaccggtacccttaccgaaccggttaaccggaccgggtaacgtaccgtaccggtaccgttaacggttacgtaacgtaccggtacggggacccgggtaccggggtaaccggtaggggtacggggtaacgttaagggtaacggttaacgggttaaaccgttcgtttaaacgttaccgttaactaacccgtaactaccgtaacgtaccgtaacgtaaacgtaactaacggacgtaacgtaacgggttaaggtaacggttacggggtaaccggtacggggaaaccgttaacgtaccgggttaacgtacccggttaccgggtaaaccgtccggaacgtaacccggtacggtcccggttaccccgttccccggttacgtcccgtacccgttaccctaccccgtaccccgttacccttccttacccgtcccgttaccgg

SEQ ID NO: 70238 - DNA, 776 bp, Homo sapiens
  misc_feature: GYAE6OF01DXWVF.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttggctgagtctggttttccttgttgtcttaagttttaaaggtgtccgagtgtgaagtgctagttggtagagtcgtggggagtcgtggtagacgtccgtgggggtccctgacgtactccgtaccgtgtcgcgtaccgtccgtcgtacgtacttacgttacgttacgttagtagttagtacgttacgtccgtacgtacgtcgtacgtacggtaccgtaccgtaccgtacggtaccggtaccggggtacgggtacggtacggtacggtacggttacgttcttacgttacgttaaggtaggttaggtacggttaggtacgtacgtacccgtagttacgtacgtacgtacgtacgtacgtacggtaggtacggtacgtacctacctaccgtacctacgtaccgtacgacgtaacgtaacgaacgaacgtaaccgtaaccgtaccgtacgttacgtacgtaccgtaacgtaacgtaacgtaacgtaacgtacgtacgtacggtaggtacggtaacgtaaccgtacccgtaccgttaaaccgttccgttaacgttacgtaacgtaacgtaacgttaacgttaccgtaccgtaaccgtaaccgttaaccgttaccgttaccgtaccgtaccgtacgtaccgg

SEQ ID NO: 70239 - DNA, 666 bp, Homo sapiens
  misc_feature: GYAE6OF01DK411.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagcgtggtttcctgtgctatttaaaggtgtcagtgtgaagtgcagttggtggaatcgtgggggatcgtggtagagccgtgggggtccctgagactctcctgtgcagcctcgtggattcattctttgatgtattatgccatgcacgtggactccgtagaacgccgtaccggggaaggtcgtggaggtggtacttctcttaagttagttggtagtggttaggtactcctacccgtataagtcgcgtaacgtactcgttggtacgggtaagggttccgtactttacccacctacgttacctacccgaagaacgaaccgaaaccgaggtaccaaacggtaaacccttcccgttagtaacttcgtacgaactaaagtacgaaccgtacgtccgtagaacggtagggcgtaccggaccgtacccgtacctttacgttaccgtaacgttggaaaccgtaacgtaaaacggttagttaaccgggtcgtaacccttaaaaccccg

SEQ ID NO: 70240 - DNA, 654 bp, Homo sapiens
  misc_feature: GYAE6OF01A60C4.49.26.C04.1.454.CMB.1.raw
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
  modified_base (492)..(492): a, c, t, g, unknown or other
  misc_feature (492)..(492): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgctattttaaaaggtgtccagtgtgaagtgcagttggtggaatcgtgggggagtcgtggtagagccgtggggggtccctgagactctcctgtgcagcctctggtacttcattctttgatgtattatcgccatcgctactggatccgtacaacggtccgtaccgggggaaggtcgtgggaggtggtctctcttaattagtggngttggtgtatcacctactatcganagtacctcgtaggtcggaagggtcgtactaccactactcctacgaggaacaacaacgagaccaacgtaacctccctagtactctagacaaagtgaacngttacctacgtaggtacggtacggaacggaccctaccgtcccttacgtaaccgtacgttacggtaacggtaaacgtaaaacgtcggtttaaccgggtaccgaaaccccttaaacccgttaaccttttaacgttttcccggaaacccgttacggtacccgggg

SEQ ID NO: 70241 - DNA, 455 bp, Homo sapiens
  misc_feature: GYAE6OF01BIXN0.49.26.C04.1.454.CMB.1.raw
  modified_base (287)..(287): a, c, t, g, unknown or other
  misc_feature (287)..(287): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
  modified_base (437)..(455): a, c, t, g, unknown or other
  misc_feature (437)..(455): n is a, c, g, or t
tcagagtcgagagacacgaccggtgctcgattttagtctagcgacttttggggttttgggggagatgcattcgccaaaaaaaatatgcttgttggtaccagaagaagtcaggccaggccccggtgttgctcgatctatgacgacagaaaccgaccctccgggatccctgagagattctctggcctccacctcgacgggacctagtcgggccctacggtttgacttatcgacgggccggggcccagggtgggaaggtatggaaggtgtacgttactatttcgttaccncaccagaccaccagtagaaaatcacagaggaatagttcggcggagggaccaagcctacgaccgtacgtagtcgacgcccgagctcgcccctcggtcactctcgttcccaccctctctctcncgtctgtgacgcggctggacaggcnatgnnnnnnnnnnnnnnnnnnn

SEQ ID NO: 70242 - DNA, 594 bp, Homo sapiens
  misc_feature: GYAE6OF01EZ78S.49.26.C04.1.454.CMB.1.raw
  modified_base (373)..(373): a, c, t, g, unknown or other
  misc_feature (373)..(373): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcattctttgatgattatgccatgcactggactccgtcaagccgtcgggggaagggtctgggaggtggtctctcttattaagtgggatggtgtatcacctatntgcagtactctggtgaagggtcagttcaacctatcctaccgaagagaacaacaggacaagtaaacctcccgttagtactctagaactaaagtacgaacgtacgtactacgaggtagggacgaaggacccgaccgtaccttactacctacgttacgtacgtaactaaaaggtcgttaacggacgtaacctaaccgttaccttaagtttcgaacctgtaccgg

SEQ ID NO: 70243 - DNA, 755 bp, Homo sapiens
  misc_feature: GYAE6OF01CD9ZC.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgacaaaaaaatntgtcttgttggtaccagaagaagtcaggccacggcccggtgttgctcatctatgacgacaagaaaccgaccctccgggactcccgtagagagacttctcgtggcctcccacctcgtaacgggacctagtacggccctacggttacgaacttacgtccgagggaccggggacccgtaaggggtagggaaggggacgttagggaaaggggttacgtaacgttaacgtttaagtttaccggtttaacctaccgtaaccgaacgaaccctaaaccgaagttaacgaaaactccaaacgtaagggaacgtaaacgttaacggtccggggaacgggtaaccgggaccgaaaggtacccgtacggtaaccccggttacccgtaccgggttaccgaaccggttaacccccggtaaagggtacccccgtaccgggttcccccccgttaccggggttaaccctacccgttaccccggttacccggtttccccccgtacccccgttcccgttcccgtttacccccg

SEQ ID NO: 70244 - DNA, 984 bp, Homo sapiens
  misc_feature: GYAE6OF01BU46G.49.26.C04.1.454.CMB.1.raw
tcagagtcgagagacacgaccggtgctcgatttagtctagcgactttgggtttggggtgggctcaggaggcagagctctgggaatctcaccgatggcctggacccctctcctgctcccctcctcactttctgcacagtctctgaggtcctcctatgagcgtgacacgacgcccacccgtcggtgtcggtcgtccccgaggacaaacggccaggactaacctgcctcgtggacgactcgactattacgaaacctaaaaaattctcggtctttacggttcggtaaccgaaggtaaaggtaacgttccgaacgggtcccgtaacgggtccccgggttagttacgccgtacgacttccgtaagtacggaaccgtaacgaaacggtaaaacccggtaccccggttacccggggtaccttacccgtaggaacgtacgttaacgttccgtcgtacggtaccctacccgaccgttacggacggggtaaccacggttaccggacctacggttacgtaacctacgtaccgaaccggggtccgggggtaccctagggggtacgggtaacgggtaacgtacgggtaacggttacgtaaaccgtttacgtttaaacggttaccggtttaacctaacccggaaacccgtaacggtaaaccctaaccggtaaaggttaaaccgtaaaaccttccgggaaacgtaaaccgggtaaaggttaaaccgttttaaccgggggttacccggggaaaccggggttaacggggtaaacccgtaaccggggttacccgttaaacccgggttaacccccgggttaccgggttaaacccggggtacccgtaaaaccccgggtaccccggttaaaccggggtacccccggttaccccccggttacccccggggtaaccggtttaccccccgtaaacccggttttcccccgttaaccccgggtttaccccccccctaacccggttttcccccgttaaccccgttccccggg

SEQ ID NO: 70245 - DNA, 404 bp, Homo sapiens
  misc_feature: GYAE6OF01C5TWJ.49.26.C04.1.454.CMB.1.raw
  modified_base (253)..(253): a, c, t, g, unknown or other
  misc_feature (253)..(253): n is a, c, g, or t
  modified_base (394)..(404): a, c, t, g, unknown or other
  misc_feature (394)..(404): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacaagaaaacgaccctccgggatccctgagagattctctggcctccacctcagggaccatggccacgttgactatcagccggggccaggtggagatgaaggtgactactattgttacncacagacacagtagaaatcaacagagaatattcggcggaggacagctgaccgtctagtcagccaagctcgcccctgtcactctcgttcccgcctcctctctctcgactcgtgacggcggctggacgaacggcgacatacgnnnnnnnnnnn

SEQ ID NO: 70246 - DNA, 754 bp, Homo sapiens
  misc_feature: GYAE6OF01E52MJ.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctaattttaaaaggtgtccagtgtgaagtgcagttggtggaatcgtggggagtcggtggtagagccgtggggggtccctgagactctcctgtgcacgcctcgtggtattcattctttagattgtaatttatcgcctatcggcctacgtggactcccggtacaacggtccggtaccggggggtaacggggtcgtaggggaggttcggggttccttacgtttacgtttaagtttaaggttggggtagtttgggttacggttacttacccgtaaccgttaacgttagtcgacctacgtacgttcggttggtagggtaacgggttacgtacttacccaccctacgtccctaaccgaaggaacgaaaccaaccgaaggaaccctaaacggtaaacccttcccgttagttactaccgtacgaacctaaagtacgaaacgtacgtaccgtacggaaggtagggtacggaaccggtacccgtacccgttaccttaccgtaactaccgtaggtaacgaaacgttaaaacgttacggttaaccggaacgtaaccccttaacgttacctttaagttccgtaacccgtcggtaccggg

SEQ ID NO: 70247 - DNA, 654 bp, Homo sapiens
  misc_feature: GYAE6OF01C783O.49.26.C04.1.454.CMB.1.raw
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctatttaaaaggtgtccagtgtgaagtgcagttggtggaatcgtgggggagtcgtggtagagcgtggggggtccctgagactctcctgtgcagcctntggattcatctttgatgattatgccatgcacgtggatccgtacaagtccgtacggggaaggtcgtaggngtggtctctntttaattaagttgggactggtgtatcgtaacctactagtgctagctcgtgtagaggggtactattaccgaactagtctaccagacgaacaaacaggtaccaaacgtaaccttacccgtagtttactactcggaactaaacgtagaaacgtacggtacttaccggaaaggtacggtacgggaaacggtacccgtaccccggttaccctttaacctaaccgttaacgttacggtaacggtaaaccaaaaaacggttacgtttaaccgggtaacgtaaccccgttaaaaccc

SEQ ID NO: 70248 - DNA, 775 bp, Homo sapiens
  misc_feature: GYAE6OF01EAQ0I.49.26.C04.1.454.CMB.1.raw
  modified_base (244)..(244): a, c, t, g, unknown or other
  misc_feature (244)..(244): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtgtcggtcgtccccaggacaaacggccaggataacctgctctggagatgcattagaacctaaaaaaatntgctttgttaggtaccagaagaagtcaggccaggccccggtgttgctcatctatgacgaacgaacgaaaaccgtaccccgtcgggactcccgtagaagagtacttctcgtcggcctcccacgttcgaacggggtacagtacggcctacggttcgaactactcgaggccgggggacccaggggttcggaaggtagtaggtaaagggtcgtaacgttaacgtttaacgtttggttaaccttaccgaaccctaacgaaccctaaaccgaacgttaaacggtaaaaactcccgtaaacgtaacggaaacgggtaaactttaacgggtttaccgggggaaccgggttaaacgggggaaaccccggtaaaaggtacccgttaacgggtaaccccgggttacccgttaacgggtaccgtaaccggtaacccccggtaaagggttcccgtacccggtcccccccggttacggttacccgtaacccgttccggttaccccggttccccccgttacccccgtttcccttcccgttaccccg

SEQ ID NO: 70249 - DNA, 408 bp, Homo sapiens
  misc_feature: GYAE6OF01AN7IY.49.26.C04.1.454.CMB.1.raw
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (398)..(408): a, c, t, g, unknown or other
  misc_feature (398)..(408): n is a, c, g, or t
tcagagtcgagagacacgaccggtgctcgatttagtctagcgactttgggtttgggggagatgcattgccaaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggcccaggtggaggatggaaggtgactactattgttactcaccagacacagtgaaaatcacagaggaatattcggacggagggacaagctcgaccgtcctaggtcacgcccaaggctcgcccctggtcactctcgtcccacctcctctctctcgctcngngcggctggcgaggcgcatacgnnnnnnnnnnn

SEQ ID NO: 70250 - DNA, 717 bp, Homo sapiens
  misc_feature: GYAE6OF01C633U.49.26.C04.1.454.CMB.1.raw
  modified_base (516)..(516): a, c, t, g, unknown or other
  misc_feature (516)..(516): n is a, c, g, or t
  modified_base (568)..(568): a, c, t, g, unknown or other
  misc_feature (568)..(568): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagtcgttgggttttccttgttgcttaagttttaaaaggtgtccagtgtgaagtgctaggttggtggaatcggtgggggagtcggtggtagacggccggtcggggggcccctaggacgtacttccgtccgtggtcgacgacgtccgttcgtggtattctagttctttgattagtattagtcgcctagtcgacacgtaggtacctaccgtacgaacggtccgggtaccggggaacggttcggtagggtacggttcgggttccttacgtttacgtttaagtttaaggtgggtagttggttagttactacctacgttatagtcgactagtactcgttaggtaggtacggtcgtactaccacctagtcccanaagaacgaacaacgacgaacctaactaaccttccgtataactccgaactaanaagtctaacgacgtaccgaggtaaggacggtagaccaccgttacccgtctttacgaacgtacgtacgtaacgaaactaaacggttccgtttaccgggaaccctaacctacccgttaacgtttaagtaccccgtaacgcggtacccgggg

SEQ ID NO: 70251 - DNA, 824 bp, Homo sapiens
  misc_feature: GYAE6OF01CPI00.49.26.C04.1.454.CMB.1.raw
  modified_base (249)..(249): a, c, t, g, unknown or other
  misc_feature (249)..(249): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggtcctcctatgagctgacacagccacctcggtgtcggtcgcccaggacaacggccaggactaacctgctcgtggagagtgcagttagaaacctaaaaaaattntcgtctttggttacgtaaccgtaagaaagaacgttcgacgggccctaccggggtccccggttagttcgctactatcgtacgtacgaacgaacgaacgaaaacccggtcccgtacccgggtactcccgtaggaacgtagtaccgtttcgtcgtcggaccctaccgtaccctacggaacggtacccgtagtacccgggtcccgtaacgttcggaaaccttcgtacccgggaccgggtacccgggggacccgtaaggggaggggaggtaacggttagggtaacgggttcgtaactttaacgttaacgttacggtttacccaaccgtaccgttaacgaacccgtaccgtaaacggtaaagtaaacgttccgaacgtaacggggtaagtaacggtaacggttaccgggaaccggggtaccgggtaaccgaacgttaccgtacgggttaccccggtacccggtaaggttacccgaacggtaccccgaaggtccccggttacccggtaccccccggtgttaccccgtaacgttcccccgtttacccggtacccccttacccgttacccgtcccttaccccgg

SEQ ID NO: 70252 - DNA, 737 bp, Homo sapiens
  misc_feature: GYAE6OF01D4HQ8.49.26.C04.1.454.CMB.1.raw
  modified_base (542)..(542): a, c, t, g, unknown or other
  misc_feature (542)..(542): n is a, c, g, or t
  modified_base (659)..(659): a, c, t, g, unknown or other
  misc_feature (659)..(659): n is a, c, g, or t
  modified_base (666)..(666): a, c, t, g, unknown or other
  misc_feature (666)..(666): n is a, c, g, or t
tcagagtcgagagacacgaccggtgctcgatttagtctagcgactttgggtttgggggctctgggaaaggagccccagccctgagattcccaggttgtttccattcggtgatcagcactgaacacagaactcaccagtggtagtttgggctgagtcgttgggtttttccttgttgtacttaaagttttaaaaggtcgtcctagtgtagaagtgacgtaggttgggtaggtaagttcgggtggggggagttcggtagggtaggacggtcccgggttcgggggtccctaggacgtaccttccgttccgtggtcgccacgtccgttacgtggtactttactattttcgtttgaattagtatttaacgtcgactactcgacctacggtacgtacgtaccgtacgacggtaccggggtaccggggtaaggtcgtagggtacgttcggtcttacttagttaagttaggtgggtagttggtacgttactacctaacgttactagtccgactaacgtcgtgtaggtacggaacggttctaactcaacctntaccgtaaccgaaagactaaaccacgaacgtaaacctaacgtaccccgttactagttacagacgtaaacaagttacgactagtacgagtacgagtacgaccacttccgtctacgtanaggttanaaagtaacgaaacgttcacccggtaactaaacccgtacttaacccgtttataacccgtactggtaacccgg

SEQ ID NO: 70253 - DNA, 822 bp, Homo sapiens
  misc_feature: GYAE6OF01CUTY4.49.26.C04.1.454.CMB.1.raw
  modified_base (700)..(700): a, c, t, g, unknown or other
  misc_feature (700)..(700): n is a, c, g, or t
tcagagtcgagagacacgaccggtgctcgatttagtctagcgactttgggtttgggggaagaggaagactgacggtccccccaggagttcaggtgcgtgggcacggtgggcatgtgtgtagtttttgtcacaagagtttgggctcaactctcttgtccctacgttggtgttgcgtgagtcgtttgggttttcctttgttgtacttaagttttaaaaggtcgtaccgagttgtagtaagtgactaggttggtaggaagttcggtagggggtacgttcggttgggtaaggcggtccgggttacggggggtccccttaggacgtaccgttccgtccgttgacgccgtacgtcccttacggtggttacttaccttagttctttagtattagtaattagtccgaccgtagttcgactccggtaggtaccttacgtaccgaacggtccggtaacggggtacggtccggtagggtacggttcgtacgttacctttagttaacgttaggtggtagttcggtacgtactaccgtaccgttagtagtaccgcgtaacgttaccttaggtaggtaacggtaggtaccgtaaccgttaccctaaccgtaacgttcccgaacgtaaacgacccgtaaccgaaagaacccggtcctaaaaccggttaacctcccgtaagttaccgtaccgaaactacgtaaagtaccgtaaacncggttaccgaaggacggtaagacgaaccgggtacccaccccggtttattaacccgtaagttaacggtcgtaaacccggtaaaagtaaacgttaccggttaacccggattaaccccgttaacc

SEQ ID NO: 70254 - DNA, 816 bp, Homo sapiens
  misc_feature: GYAE6OF01D75C5.49.26.C04.1.454.CMB.1.raw
  modified_base (244)..(244): a, c, t, g, unknown or other
  misc_feature (244)..(244): n is a, c, g, or t
tcagagtcgagagacacgaccggtgctcgatttagtctagcgactttgggtttggggtgggcgtcaggaggccagagctctgggaatctcaccatggcctggaccctctcctgctccccctcctcactttctgcacagtctctgaggcctcctatgagctgtacacagccaccctggtgtcggtgtccccaggacaaacggccaggataacctgctctggagagtgcattgacctaaaaaaatntgctttgttaggtacctaggaagaagtcaggccgaggccccggtgttgctcatctatcgacgacacgaaaacgcccgtaccgggatcccgtaggagagattcgtctggctccactcgagggaccagtcgcctacgtttgacttacgtacgacgggccgggaccaggggttacggaggtacgtaggaacggttacgtaaccgttacgttaagtttacgtttaaacgtccgtaaacccgtaacggtaacccgtaacccgtaaaggttaacgtaaaaacgttccgaaaccgtaagggtaaacgggtaaacctttaaacggggtttacccggggaacggggtaaaacggggtaacccggtaaacgggtacccggttaacggtaaaccccggggttaccccttaaacggggggttaccctaacccgggttaaacccccgtaaaggggtaccccggtttaccccgggtacccccccccgggtttaacggggttacccccttaaccggttttaccccgttaacccggtttaccccccccgttaaacccccggttccccgtttaccccgtttaccccggg

SEQ ID NO: 70255 - DNA, 862 bp, Homo sapiens
  misc_feature: GYAE6OF01AWCQF.49.26.C04.1.454.CMB.1.raw
tcagagtcgagagacacgaccggtgctcgatttagtctagcgactttggggtttgggggtgggctcaggaggcagagctctgggaatctcaccatggcctggacccctctcctgcctccccctcctcactttctgcacagtctctgacggcctcctatgagctagacacacgccctacccgtcgggtcggtccggtcgtccccgaaggaaccgaaaccggccgaagggtaactaacctggtccttcgtagggaagatcgactaattaacgaaaaacctaaaaaaattgtacgttcgtttaggttacggtaaccgaaaggaaaggtaacgtaccgacgggacccgaccggggtccccggttgttcgtcctacgacttacgtaagtacggaaccgaacgaaaaccggtaaaaccccggaccccggtaccggtaacctcccgtaaggacgtacgttacttccgtcgtcggtccctaccctaccggtacggaacggtactacggtaccggtacctacggttacgtaaccgtacgtaccgggtccggggacccggggaacggtacggggtagggacgggtaggtaacgggtaagtacgtaacttacgttagttaccgtaacctacccgaaaccgacgaacgtacgtaaagtaacgaaactcgaaacggtaaggaacggtaaacggtacggtaccggggaacggtaaccgggtaaccgtacgtaccggttaccggtaacccggttcgtaacgggaccacccggtaaacccggtcgttaccccggacccggtcccccgttaccggttaccccttcccgggtttaccccgtccccccggttccccctcccgttccccgttccgtaccccg

SEQ ID NO: 70256 - DNA, 823 bp, Homo sapiens
  misc_feature: GYAE6OF01CCZCS.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctatttaaaaggtgtccagtgtgaagtgcagttggtggaatcgtggggagtcgtggtagagccgtgggggtccctgagactctctgtcgcacgcctcgtggtacttctagttcgtttgtagtgtattacgtcgacctagtcgacctacgtacggtaccgtccgtacgaacggtcccgggtaccgggggggtaaacgggttccggtaggggttacgggttcgggttccttacgtttaccgtttaaagttttaaaggtttggggtaagtttcgggttacggttaactacccttaaccgttaacgttaacgtacggtacgtaacggtaccttacggtttagggtaacgggttaaccggggttattaacctttacccctaaccgttaacgttcccgtacccgaaagtaaccgggaaaccaaacggaacggtaacctaaacggtaacccctttcccgtagttaacctaccggtagaaacgtaaagtacgtaaacgcgttacgaacggtaagggacggttaaggaacccggtaaccccgtcccggtttaccctttacctaaacggttcgttaaacggtacggtaaaacccggtaaaaggttaccccggtttaacgggaaccctaaacccgtttaaacccg

SEQ ID NO: 70257 - DNA, 703 bp, Homo sapiens
  misc_feature: GYAE6OF01BMBN2.49.26.C04.1.454.CMB.1.raw
  modified_base (315)..(315): a, c, t, g, unknown or other
  misc_feature (315)..(315): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (546)..(546): a, c, t, g, unknown or other
  misc_feature (546)..(546): n is a, c, g, or t
  modified_base (553)..(553): a, c, t, g, unknown or other
  misc_feature (553)..(553): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatgggagtttgggctgagcttgggttttccttgttgtctaattttaaaaggtgtccagtgtgaagtgctaggttggtaggatcgtagggggacgttcggtagggtagaggccgttggggggtcccttgacgtacctctcctgtcgcacgcctcgtgtattcgtattctttgatgtatttancgacctatcgtacgtacgtaggtacctccgtacgaacggtccggtacggggtaacggtgtagggtacggtcggtccgttctttattaacgttaaggttgggtaagttggtagtactcacctntacgcgtanacgtctgtaggtagacggtcgtactcacctactacgttacgaagtacaactaacgacgaacgaactaaacccgttccttagtacgtactaccggaataanacgtaanacgttacggacgtagggaaccgacgtacggtaacccctccgttaaccgtacttaccgtacgcgggttaaactaacgggtaaacgtttacgtaacccggacccttaaccggaacttaccgttttaacggacccttaaccggcgttaccggg

SEQ ID NO: 70258 - DNA, 761 bp, Homo sapiens
  misc_feature: GYAE6OF01CJDQ9.49.26.C04.1.454.CMB.1.raw
  modified_base (245)..(245): a, c, t, g, unknown or other
  misc_feature (245)..(245): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctctatgagctgacacacgccacccgtcggtgtcggtcgtccccaggaccaaacggccaggataacctgctcgtggagatgcattgaaccaaaaaatntgtcttgtaggtaccagaagaacgtcgaggaccgacgggccccggttgttcgcgtacactctatcggaccgaacgaacgaaaaccgtacccgtccggacctccgagacgagtacttccgtcgtcggtcctacccaccgttacggacgggaactaggtcggacccttaggttcgaacttacgtccgtacggggcccggggaccgtagggtagggaacggtaggtagggtaagggtcgtaaccgttaacgtttagtttacgttacctaaccgtaacctaacggaacctaacccgtaaggtaaacgtaaacgtaaccgaaacggaaggtaaacggttaacgttaacgggttaccggggaacggggtaaccgggaaccgaaacggtccgtaccggtacccggttaccggtacggtaaccgacccgggaacccgacgggtacccgtccccggtaccccggtcccgttacctacccgttaccgtttccccgttacccccgcccctttccgtcccgttacccg

SEQ ID NO: 70259 - DNA, 708 bp, Homo sapiens
  misc_feature: GYAE6OF01D6MGX.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcggtggtagagccgtggggggtccctgagactctcctgtgcagcctctggattcatctttgatgattatgccatgcactgatccgtcaacgcgtccggggaaggtcgtgggagtgggtctcttcttattagttgggattggtggttatcgtaaccttactatcgacctagtacctgtggtggtaaaggggttccgtaattccgaccctagtcctacccgaagaaacgtaaccaaacagaccaacgtaaaccttcccctagttaacttccgtagaactaaaagtacgtaaactacgttaccgtacgtaaggtagggttaacggaacgggtaacccgtaccccgtacccgtttaccgttaaacccgttaacgtttacggtaccgaaaccgttaaaaaggttccggtttaaacccgggtaacgtaaccccgttaaaccgtaaccccttttaagttttttaaccggaaccccgtaacccggttacccgggg

SEQ ID NO: 70260 - DNA, 810 bp, Homo sapiens
  misc_feature: GYAE6OF01D1SA1.49.26.C04.1.454.CMB.1.raw
  modified_base (251)..(251): a, c, t, g, unknown or other
  misc_feature (251)..(251): n is a, c, g, or t
  modified_base (686)..(686): a, c, t, g, unknown or other
  misc_feature (686)..(686): n is a, c, g, or t
tcagagtcgagagacacgaccggtgctcgatttagtctagcgactttgggtttggggtgggctcaggaggcagagctctgggaatctcaccatggcctggaccctctcctgctccccctcctctactttctgcacagtctctgaggcctcctatgagctgacacacgccaccgtcggtgtcggtcgtcccaggaacaacggccaggactaacctgctcgtggagatgctattacgaaacctaaaaaaagtntacgtcgtttaggttacggtaaccgtaaggaaacgtaagtaccggacgggacccggaccggggtccccgggtttgttcggtaccttcgtaacttaccgtacgtaacggaaccggaaaccgaaaccggtaaaaccccggtaccccggtaccggggtacctaccggttaggaacggtagttacttccgtcgtccgtacctacccgaccgtacggacggtaactacgtaccggacctacgttaacgtactacgtcgacgggccgggtaccggtagggtacgggaagggtacgtaggtaacggtactaaccgtttaacttaggtttacttaacccgaccgaaacccggaacgtaaccgtaacgtaaggttaaacaaaccgttaccgaaggtaaaggtaacggtaacgtttacgggaccggggaacgggaaaccgggtanaccggttccgtacgacccggtttacgacggtacaaccggtacccgacggtcccgtacccggtccccggttagtacccgtaccgttcccgtttaccccgtcccccgtaccttccgtccttccccg

SEQ ID NO: 70261 - DNA, 747 bp, Homo sapiens
  misc_feature: GYAE6OF01CMXIE.49.26.C04.1.454.CMB.1.raw
  modified_base (595)..(595): a, c, t, g, unknown or other
  misc_feature (595)..(595): n is a, c, g, or t
tcagagtcgagagacacgaccggtgctcgatttagtctagcgactttgggtttgggggctctgggaaaggagccccagccctgacgattcccaggtgtttccattcggtgatcagcactgaacacagaactcaccatggagttggctgagccggttttctgttgctatttaaagtgtccagtgtgagtgcagttggtggaatcgtggggagtcgtggtagagccgtgggggtcctgagactctcctgtcgcagcctctggtacttcattctttagattgtattattcgacctatcgtcacgttggtactccggtacaacggtccggtaccgggggaaacggttcggtagggtagttcgggttccttcgttaccgtttaagtttaaggttgggtagttacgggtaggttaactaccggtaaccttaacgttagtcggacctaagtaccggttcttaggttaggaaacggggttcacttccacccgtaacgtcctaacccgaaggaacgaaccaaaccgaggaacccaaggtaaccccttcctagttaactcgttacaaactaagtacgaaatccgtacttacgaaggtcgggtaanaccggtaacctacccggtccttttacctaacggttaccttggtaacggtaaaccgtaaaaggttacgtttaccggggtaaccaaacccctaccgtttaaaccccgtttaaccgtttacaaaccccgggttcctaaccgggaaccccccgggg

SEQ ID NO: 70262 - DNA, 772 bp, Homo sapiens
  misc_feature: GYAE6OF01CO2IV.49.26.C04.1.454.CMB.1.raw
tcagagtcgagagacacgaccggtgctcgatttagtctagcgactttgggtttgggggtgggctcaggaggcagagctctgggaatctcaccatggcctggacccctctcctgcctccccctcctctactttctgcacagtctctgaggcctctatgagctgacacagccaccgtcggtgtcggtcgtacccgaggaccaacggccaggactaacctgctcgtggagatgctattacgaccaaagctaatatgtacttacgtaggtaccaggacgaagaacgaccgaacgggacccgaccggtccccttgttaccttacggtaacttaccgtttaaagttttaaacgttaaaagttaccgttttaggaacgggtaccgggtacccgttacgggaacccgggtacccccgttggaacggtccgttaacgtttccgttcgtccggtcccttacccgtagtccctaccgacggtaaccgaaccgtaaacgtaacggtaccgtaacggttaaccgaacctacgtaacgagggttacgggaccggtcgggacgaggaacgggacgacggtctaaggtactagttacgtcgtcagttaccatacgtaagacgtaaggtaggtcgtaccttcggtttcgttcggttacgttacggtacggggtaccggggtaagtcccgtaagggtcccgtaacggggtacccgttacgggacgtaccggacccgaccccgggttaacggccccgttacccggtacccccgttcggttccctaacccgg

SEQ ID NO: 70263 - DNA, 793 bp, Homo sapiens
  misc_feature: GYAE6OF01BFZG1.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggcctctatgagctgacacacgcccacccgtcggtgtcggtcgtaccccgaaggacaaacggccaaggactaacctgctcgtaggagatgactagttcgaccaaagacaatagtcgtacttacgtacggtaccacgacgaacgaacgccgacggcccgaccggtccccttggttccttagtacttacttaaattttaacgtaaacgttacgtttagacgggtacgggtccctaccggaccgggaccccgtaggacgtcgtactttcgtcgtcggtcctaccgacggtcctacgacgacgaaccaacgtacgtacctacggttaccgaacgtacgttacggacgggttacgggaccggtaccgggcgaaacggggtacgggaaccggaacgggttccttaacgggttaaacttacgtttaccgttaggtaccgtacgtaaccgtaagttacgaacggtacgtaaaggttacgggtacgttaccctttaagttccggttacggtttaccggttacgggttaacccgggggacggtaaccggggtaaccctaagggccccggtttaaccgggcccgtttacggtacggaccgaccgggtaacccgaccggtcccgttaccccggttcccccggttcgtaaccgttccccgg

SEQ ID NO: 70264 - DNA, 909 bp, Homo sapiens
  misc_feature: GYAE6OF01DPYB1.49.26.C04.1.454.CMB.1.raw
tcagagtcgagagacacgaccggtgctcgatttagtctagcgactttgggtttgggggtcgtctggggaaaggaggccccagccctgacgtagttccctacggtgtttccattccggtgatcgagcactgaacacaagaactacaccatggtacgtttgggctggtaggtcttgggtttttccttggtttcggttacctttaagtttttaaaaggtcgttaccttaaggttcgttacgtaagtgtcgtaggtttggtaggtaacgttcggtgggggtacggttcggtagggtacgacggtccggttccgggggtacccgtcggtacgtacctactccgtgtcgtcgtacgtccgttcgtggtactttacgtatttacgttagtattagttacgtttacgtacgtacctaacgtcgtaccgttacggttacgggtacccgttaccggtacggtaaccgggtccggggtaaccggggggtaacggtttcgggtaggggttacggttccgggtttacttaccgtttaacgtttaagttaacggttaggtacgttacggtaacgttacgtaccttaacgttaagtttagtacgcgttacggtacggttacgttaggtaacggtacgggtaaccgttacgtaaccgtaccctacgttacccgtacgtaaagtaccggaactaaacgaacgtaccgtaaccgttaaccgtccgttaacgttacgttactaaacgaacttaaacggactaaacgtacggttaacgtaccggtaaaggtaaccggtaacgtaaaccgtcccggtaacctttacccgttaagtaccttaggtacgtaaacggtaaacttaaaggttcccgttaaccgtacgtaaccctttaacgttacttttacgacccgaccgtttggaaccccggg

SEQ ID NO: 70265 - DNA, 696 bp, Homo sapiens
  misc_feature: GYAE6OF01BG64C.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagattgggctcaactctcttgtccaccttggtgttgctgagcttgggttttccttgttgcttaattttaaaaggtgtccagtgtgaagtgcagttggtggaatcgtgggggagtcgtggtagagccgtggggggtccctgagactctcctgtcgcagcctcgtggtattctattctttgatgtattatcgccagtcgctacgtggtactccgtacgaacggtccggtaccgggggtaagggtcgtagggtaggttcgggtcttcgttactttaagttaaggttgggtagtgggttgtactaccgtaacctacgtactgactacgtacttcgtggtacggtagggtctacgttcactctcaccgagacgaacaacgacgactaacgtaacccttcctagtactcgtaacgaactaaacgttacaaccgttacgtacccgtaacggaaggggtacggtaacggaacccggtacccgtaccccgtttaccctttacgtaacccttacggttacgaaacggtaaacgtaaaacggtttaccgtaaccgggtaccaaacccgttaaacccg

SEQ ID NO: 70266 - DNA, 817 bp, Homo sapiens
  misc_feature: GYAE6OF01AFMAW.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagttgggctgagctgggtttccttgttgcttatttaaaaggtgtcctagtgtgaagtgctaggttggtacggtaatcgtgggggtagtcggtgggtagaggcccggtcggggggttccctaggaacgtccgttcctccgttggtagcctacggtccttcgtgggtatttcctagttcctttggtaattcggtaatttacgtcggaccctattcgtacctacgtcggtaccttccgtacacggtccgggtaccgggggggtaaggttccgtaggggtaacggttccgggttaccttacgtttaccgtttaaggtttaacggttagggggtacttggggtttaacggactttaacccgaacccgttaacctttaaggtacccggtagtaaaccggtacccttttagggtaaccgggttaaggggttaaaccgggttccgtaaaccgttttacccgaacccgtacgttaacccccgtacggaaaccggtaaaccgtaacccgaaacgaacggttaaccgaaacccggttaaacccgttacccgttaagtaccgtacgttaacggaactaacgtaacggaacttaaggtcacgtaggacggtgaaccgacgtacctacctactactacgtagtacgaaacgtaatacctacggacacctaacttacctattcgcctggtaccg

SEQ ID NO: 70267 - DNA, 726 bp, Homo sapiens
  misc_feature: GYAE6OF01CZERN.49.26.C04.1.454.CMB.1.raw
  modified_base (683)..(683): a, c, t, g, unknown or other
  misc_feature (683)..(683): n is a, c, g, or t
tcagagtcgagagacacgaccggtgctcgatttagtctagcgactttgggtttggggtgggctcaggaggcagagctctgggaatctcaccatggcctggacccctctcctgcctcccctcctcctactttctgcacagtctctgacgcctcctatgagctgacacacgcccaccgtcggtgtcggtcgtcccaggacaaaccggccaggactaactgctcgtggagtatgactattacgaaaccaaaaaattgtagtaccttaggttcggaccgtaaggaaagtacgtccgaacggccgacgggcccggttagtcgctactattcctagtacgacgacgaaacgtaaccgaccggtaccggaacttccggtagacgtacgtacttactcgtacggtaccctccgaaccgtaccgtacgggaacccttaggtaccggtaccgtaacggttcgtaactcggtacgacggtccggggaccgtaggggtcggaggtagtaggtaacggtacgtacttacgttatttaccgtaacgtaccaacgacgaacctaacgtagtaacgaaactcgaacgaggtaacgttaactagggttccgggaaccgggtaacgtaccggaatccggaccggtacccggtacgttaccgacgacccgaccgacggtaccccggtctcccggtacccgtntaccccgttcgaccccgtttacccgcccttccttcgttacccg

SEQ ID NO: 70268 - DNA, 558 bp, Homo sapiens
  misc_feature: GYAE6OF01DFZ9F.49.26.C04.1.454.CMB.1.raw
  modified_base (217)..(217): a, c, t, g, unknown or other
  misc_feature (217)..(217): n is a, c, g, or t
  modified_base (504)..(504): a, c, t, g, unknown or other
  misc_feature (504)..(504): n is a, c, g, or t
  modified_base (530)..(558): a, c, t, g, unknown or other
  misc_feature (530)..(558): n is a, c, g, or t
tcagagtcgagagacacgaccggtgctcgatttagtctagcgactttgggtttggggagatgcattgaccaaaaaaatatgcttgttggtaccagaagaagtcaggccaggccccggtgttgctcatctatgacgacaacgaaaacgaccccgtccggactcccgtggagatattctcgtggcctccacctcgacgggaccagtcggacctacgttnacgtatacgcgggccggggcccgagggtagggagtagtagggtaaggtgaaccttacttatttacgttaccaccgaactaacggaccaccgtaagttaaacgaaactaccgaacgaaggaaacgtaagtttacggtcggggacggggaacggacctaacggccgtacggtaccccggttacgtacggtccaccgacccgacggtcccgtcccggtcccccgtacgtacctcgttccctccgtaccccctaccttcctctcgtcctacgtcctgacgcggcggtacgngtaccgacggcctagagtcgagctannnnnnnnnnnnnnnnnnnnnnnnnnnnn

SEQ ID NO: 70269 - DNA, 837 bp, Homo sapiens
  misc_feature: GYAE6OF01D3984.49.26.C04.1.454.CMB.1.raw
  modified_base (68)..(68): a, c, t, g, unknown or other
  misc_feature (68)..(68): n is a, c, g, or t
  modified_base (190)..(190): a, c, t, g, unknown or other
  misc_feature (190)..(190): n is a, c, g, or t
tcagagtcgagagacacgaccggtgctcgatttagtctagcgactttgggtttggggggaagaggaanactgacggtcccccaggagttcaggtgctgggcacggtgggcatgtgtgagttttgtcacaagatttgggctcaactctcttgtccaccttggtgttgctgagcgttgggttttccttgttntcttaattttaaaggtcgtccagtgtagaagtgctagttggtcgtaatcgtcgggggagtcgtggtagacggtccggtggggggtccctgacgacttctccgtagtcgacgtacgtcccttcgtagggtctttaccgtatttcgttttagattaggtattacgtcggacctagtcgacctacgtcggtaccttccgacgaacggtccgggtacggggaagggttcgtagggagttcgggtcttacgttatttaacgttaggttgggagtttcggtaggtacttacgtacctaacgttgccgacgtaaacgtcttacggttaggtaccggtaaagggtcgtaacctttacccgacgttaccgttacctacccggaaggaactacccaacggacgtacccgtaaaccgttaacccgtcccgttttagaacgtttaaccgtaacgtaaaccgggttaaataccgggtaaaccgttcgtaacccgttaagggtaaccgggtaaacgggtacgggaaacccgggttacccctaccggggtttaacccctttttaacgaaccggttaaccggtttccgggaaacccgtaaaagttttaaaaccccggggtagggtttaaaccccccggtacttaaaaaccccgggtttacccc

SEQ ID NO: 70270 - DNA, 658 bp, Homo sapiens
  misc_feature: GYAE6OF01CUQJ8.49.26.C04.1.454.CMB.1.raw
  modified_base (132)..(132): a, c, t, g, unknown or other
  misc_feature (132)..(132): n is a, c, g, or t
  modified_base (134)..(134): a, c, t, g, unknown or other
  misc_feature (134)..(134): n is a, c, g, or t
  modified_base (144)..(144): a, c, t, g, unknown or other
  misc_feature (144)..(144): n is a, c, g, or t
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (361)..(361): a, c, t, g, unknown or other
  misc_feature (361)..(361): n is a, c, g, or t
  modified_base (505)..(505): a, c, t, g, unknown or other
  misc_feature (505)..(505): n is a, c, g, or t
  modified_base (616)..(616): a, c, t, g, unknown or other
  misc_feature (616)..(616): n is a, c, g, or t
  modified_base (626)..(626): a, c, t, g, unknown or other
  misc_feature (626)..(626): n is a, c, g, or t
tcagagtcgagagacacgaccggtgctcgatttagtctagcgactttgggtttggggtgggctcaggaggcagagctctgggaatctcaccatggcctcggacccctctcctcgcctcccctctctctttcncncatcgtctcngacggtcctcctaatgagcacgaacactacgacccnccgtcggtcgttccggtacncccgaaggaacaacgccgaagtactacgngctacgnggatatgcaagtacaaataaaatagtcgttgtagacaagatacgcgcggtacncggtacgtntcgactcagttcagacaagacaacggaaacctccgacggtacctccgaaagtacgacttaacnctaaggtcctacccggacaccccgtaggaacggacttacgcggtaaccgtatacgatacgtacggacggccgttaaggacgtagaggtagtaggaagtccgtatagttacgtactaagaacaaccgagaaccaacgaaggtaanaaaccgacgaaggaagtaaagtaacgacggttccggaaagtaccgaacggacttaccgaggtaccctaacggtacggtacccacggtaaccgtacggactcccggttaccnccggttaacnccgtacgtcccttacccacgtcctcggtaacc

SEQ ID NO: 70271 - DNA, 796 bp, Homo sapiens
  misc_feature: GYAE6OF01A4WZZ.49.26.C04.1.454.CMB.1.raw
  modified_base (279)..(279): a, c, t, g, unknown or other
  misc_feature (279)..(279): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
tcagagtcgagagacacgaccggtgctcgatttagtctagcgactttgggtttgggggggaagaggaagactgacggtccccccaggagttcaggtgctgggcacggtgggcatgtgtgagttttgtcacaagatttgggctcaactctcttgtccaccttggtgttgctgagcgttgggtttttccttgttgtcttagttttaaaaggtgtccagtgtgaagtgctagttggtggaatcgtgggggagtcgtggtagagccggtcgggggtccctganctctcctgtcgcacgcctctggtacttcattctttgatgtattangcctagtcncacgtggtactaccgtacgaacggtccgggtaccgggggtaagggtcggtagggtacggttcgggtccttacctttacgtttaagttttaaggttggggtagttgggttagggttaactaccgtaacccttaacgtttagtgaccgtacggtaccttacgtggttaacggggtaacggggttaccgtaccgttaacccctaccccgtacgttacccctacccgaaggaaaccgaaaccgaaaaccgtaccgtaaaccaaaccgttaaaccccgttaccccttagttaacccgttacgtaaccgtaactaaagaacgtaacgttacgttacgtacgtaagggtacggtaccgggaaaccggacccgttaccccgttaccctttaaccggttacccttaacgtgtaaaccggtaaaccgtaaaggttacccggttaaccgggtaaccgtaaccccgttaaacccg

SEQ ID NO: 70272 - DNA, 738 bp, Homo sapiens
  misc_feature: GYAE6OF01CH8I0.49.26.C04.1.454.CMB.1.raw
tcagagtcgagagacacgaccggtgctcgatttagtctagcgactttgggtttggggtgggcgtcaggaggcagagctcgtgggaatctcaccatggcctggacccctctcctcgccttccccctcctctactttctgcacagtctctgcggcctctatgagctagacacacgcccacccgtcggtgtccggtcgtcccgaaggacgaaaccggccgaaggactaaccgtgctcgtaggagtagtcgctattacgaaaaccaaaaaaattgtcgttcgtttaggttacggtaaccgaagtaaagaacgtcgacggaccgaccgggtcccggttgttcgctacgacttctacgtagaaccgaacgaaaccggaaacccgcccggtaccggacctaccgtaggagtactacttccgtcgtcgtaccctccgaccgtcggaaccgggactacggtccggactacggttacgaacgttacgtacggaccggggtcccggggaccggtaggggtagggaacgtagtaacggtacggtacgttaactttacgttactttacgttacctaacaaccgaacgaactaacgtaaagtaactaaacgtcgaaggtaagaagttacggtacggtaacgggacgtaacggaccacggtctacggtaccgtcggagaccgaccggaccgtcgtcccgtcccgtcccggtcgttacctcgttccgtcccgtccctccccttccgtccttccg

SEQ ID NO: 70273 - DNA, 473 bp, Homo sapiens
  misc_feature: GYAE6OF01ETJ6M.49.26.C04.1.454.CMB.1.raw
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (416)..(416): a, c, t, g, unknown or other
  misc_feature (416)..(416): n is a, c, g, or t
  modified_base (445)..(473): a, c, t, g, unknown or other
  misc_feature (445)..(473): n is a, c, g, or t
tcagagtcgagagacacgaccggtgctcgatttagtctagcgactttggggtttggggagatgcattgaccaaaaaaatatgcttgttggtaccagaagaagtcaggccaggcccggtgttgctcatctatgacgacagaaaaccgccctccgggatccctgagagattctctggcctcccacctcaggaccatcggccacgttgactatcaggccggggcccagggtggagtntaggaggtgactatntttcgtanccacagtaccacagtagaaaactcgaacaggaaggaattagttcggcggtaagggaccaaagcctacgacccgcttacggtcgacgcccaaggcctcgcccccgtgcacctcgtcgttcccctacccctcctccgtcctctccgaacgttccagggacncggggcttcggacgacggcgacatacggnnnnnnnnnnnnnnnnnnnnnnnnnnnnn

SEQ ID NO: 70274 - DNA, 910 bp, Homo sapiens
  misc_feature: GYAE6OF01AN553.49.26.C04.1.454.CMB.1.raw
  modified_base (272)..(272): a, c, t, g, unknown or other
  misc_feature (272)..(272): n is a, c, g, or t
tcagagtcgagagacacgaccggtgctcgatttagtctagcgactttgggtttgggggtgggctcaggaggcagagctctgggaatctcaccatggcctcggaccctcctcctgcctccccctccctcctacttctgcacagtctctgaggcctcctatgagctgacacacgcccacccgtcggtcggtccggtcgtaccccgacggaacgaacggccgaggaactaacctcgctccggtaggagatggactattacgaaacctaaaaaatntagtcgttacgttaggtaaccgaaggtaaagaaggtaccgacggaccggtaccggggtcccggttacggttacgtccggtactacttacgttacgtacggaaccgtaaccgaaacgggtaaaaacccggaccccgtaccggggtaaccttaccgtagacgggtaacggtacttcctcggttaccgtacctccgaccgtacggtaacggacccggtaacgcggtaacccgtaccggtttacgaacgttaccgttacggaccggggacccggggggtcccgtaagggggttacggggaacggggtaccggtaagggtaccgggttacgtaaccggtttaacgttacgtttaccggtttaccgtaaccgtaccggtaaaccgaccgttaaaaccggaacgtaaacgttaaacgtaaaccgtaacggtaaacggaacggttaaacggttaacgggtaacggggtaaccgggggtaacgggtaaccggggtaaccgacggtacccgggtaaccggttaccgtaaccgggtacccgaaacggtacccggaaccggttacccggtacccggtccccggtacccggtacccgttacccgttcccgttaccccgttacccgtcccccgttaccccgtccgttccccg

SEQ ID NO: 70275 - DNA, 752 bp, Homo sapiens
  misc_feature: GYAE6OF01AJXB5.49.26.C04.1.454.CMB.1.raw
  modified_base (129)..(129): a, c, t, g, unknown or other
  misc_feature (129)..(129): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
tcagagtcgagagacacgaccggtgctcgatttagtctagcgactttgggtttggggtgggctcaggaggcagagctctgggaatctcaccatggcctggaccctctcctgctccccctctcactttcngcacagtctctgagcctctatgagctgacacagccaccctcggtgtcggtcgtccccaggacaaacggccaggataacctgctctgganatgcatgaaccaaaaatntgcttgtgtacagagagtcaggccaggcccgtgttcgctcatctatcgacgacaacgaaaccgcccgtacgggactcccgtagacgtacgtattcgtacgtcggcctacccaccgtacggaacggaccgtacgtcggaccctaacggtttcgaacttagccgtaacgggcccggggggtaccctagggggtcgggaacgggtacgtagggaaacgggttcgtaacttacgtttacgtttacgtttacctaccgtaaacccgaacgtaacctaaccgaagggttaacgaaaacttccgaaacgtaagggtaaacggtaacgttaacgggttaccggggaacgggtaaaccggggaaccgtaacggacccgggttcggaaaccccggtttccggtaacgggttacccgaccggtaaccccggtaacggtcccgtaccccgggcccccgtttaccgggtcccttaccgttaccccgttcccgttaacccccccacccgtttccccgttaccttccccgg

SEQ ID NO: 70276 - DNA, 641 bp, Homo sapiens
  misc_feature: GYAE6OF01BQ09T.49.26.C04.1.454.CMB.1.raw
  modified_base (613)..(641): a, c, t, g, unknown or other
  misc_feature (613)..(641): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgacccctccgggatccctgagagattctcgtggcctcccaccctcgacgggaccagtcggccctacgttgactactcgacggccggggcccaggggtcggaggagtaggaaggtcgtacttaacttatttacgttaccgtaccaacccgtaaagaaaaccctaaggtagtaaaaactccaacgaaggtaaaggtaaagttaaccgttaccgggggaccgggggaaacgggaaccccgtaaacggtccgtaccggtacccggttacccgtttacgggtaccaaccgggacccccgaaagggttccccgtcccggtccccccccggtttccgggtacccctacccttcccggtttccccggtttacccccccgtcccccgttcccccttcctttccccttcccgttaccggtccttaccggtacgtacggggtccgggtcggtacggaacggacggtacgccgtaagtacgnnnnnnnnnnnnnnnnnnnnnnnnnnnnn

SEQ ID NO: 70277 - DNA, 784 bp, Homo sapiens
  misc_feature: GYAE6OF01DRT0K.49.26.C04.1.454.CMB.1.raw
  modified_base (133)..(133): a, c, t, g, unknown or other
  misc_feature (133)..(133): n is a, c, g, or t
  modified_base (161)..(161): a, c, t, g, unknown or other
  misc_feature (161)..(161): n is a, c, g, or t
  modified_base (215)..(215): a, c, t, g, unknown or other
  misc_feature (215)..(215): n is a, c, g, or t
tcagagtcgagagacacgaccggtgctcgatttagtctagcgactttgggtttggggtgggctcaggaggcagagctctgggaatctcaccatggcctggacccctctcctcgcctccccctctctactttcncgcactagtctctgacgtcctctatganctgacacacgcccaccgtggtcgtcggtacaccgagaacgaacgcgagactacngctgtgatagtcacgttagtaacaaaactaaaaatgttcgtacgttggttaacgaacgaaaggaacgtacgacggtaccggaccggtccgggtacccggttggtacgtctactacgttacgttacgaacggaacgaaacgtaaaacccgtaacccgtacccggtacgggttaccaacggtagaacgtacttctaccgtcgtccgtacctcccgtaacgacggtaaccggactacgtcccgaagtccgttaataccggttaccgacggaccgggggtaccgggtaacgggtagggtacggggaaggtaacggttagggaacggttacgtacgttttaacgttaacggttttaccgttaaccaaccgtaccgttaacgacgtaaactaaggtaactaagtaaccgaggtaaaggaacgttaacgtaacgggtacgaacggggtaaccacggtaaccgtacgtacgtaccgttacggtacgtaccggaaccgtaccggtaccgccgtacccgtcccggttccgtaccgtaccgttcccgtaccggtcccccttaccgttccttccgtacccg

SEQ ID NO: 70278 - DNA, 807 bp, Homo sapiens
  misc_feature: GYAE6OF01DH6DG.49.26.C04.1.454.CMB.1.raw
  modified_base (137)..(137): a, c, t, g, unknown or other
  misc_feature (137)..(137): n is a, c, g, or t
  modified_base (141)..(141): a, c, t, g, unknown or other
  misc_feature (141)..(141): n is a, c, g, or t
tcagagtcgagagacacgaccggtgctcgatttagtctagcgactttggggtttgggggtgggctcagggaggcagagctcgtgggaatctcaccatggcctcggacccctcctcctgcctccccctctcactttcngcanagtctctggacggcctcctatgagctagaccacaccgccctacccgtcggtcggtccggtccgaccccgaaggaaccgaacggccgtacggaactaccgtgactcggtaggagatcgactaacgtaacaaaacctaaaaatgtcggttacgttaggttaacggaaaccgaaggtaaacggtacgtacggaccgggacccggtaccgggtcccggttcggttccgtacgtacgtacttacgtaggtaacgaaccgaacgaaaacccggtaaacccggtacccggtccggtaccgtaccggtagacggttacgttcttcggtacccgccgttaccacccgttaaccgacggtaaccggacctcggttacccggaggttacggtactaaccgtcggtaacggcgggcccgggtagggtagggaacggagggtagtacgggtaacgtccgttaagttctttaacggtcttaaccgactacgaactacgaggtaacaactagacgtaaaggcggtaacgtaacgtaacggggtccgggaaccgggtaacggtaccgaacggtcggtaccgttccgaaccgtacgggacgtacccggaccgtccgtacccggccccgtcccgttacgccgttaccctccggttacccctccccgtacctccgtccttacccg

SEQ ID NO: 70279 - DNA, 769 bp, Homo sapiens
  misc_feature: GYAE6OF01BARFA.49.26.C04.1.454.CMB.1.raw
tcagagtcgagagacacgaccggtgctcgatttagtctagcgactttgggtttgggggtgggctcaggaggcagagctctgggaatctcaccatggcctggaccctctcctgcctcccccctcctctactttctgcacagtctctggacggcctcctatgagctgacacagccacccgtggtgtcggtcgtcccaggacaacggcaggactaaccgtgctcgtaggagatgactattagaaacctaaaaaaattgttcgtactttggttacggaaccgtaaggaagtaacgtcgacgggcccgacgggccccggttgttcgactacgtactcgtagtacggaacgaacgaacggaaaacccggcccgtaccgggtactcccgtaggaacgtagtaactttcgtcgtacggaccctacccgaccgtacgaacgggtacctaacggcggtaccgtacgttcggtaactcgtaccggacgggcccggggaccgtagggtacgggagtaagtacggtaaggtctaacgttactagtttacgtactaccgacgacgtaccaccgtagtaaacgaactacgagaacggtaggtaatttaccggggacggaaccgggggaacgtacccgtaaaggcccggttaccgaaccggtttcgtaacggacccgaacccggaacccggcgtccccgggttaaccccgccccgttaacgggtcccctacccggtttacccgtcccctttaccccccgtaaccctttccccgtccgttaccccg

SEQ ID NO: 70280 - DNA, 831 bp, Homo sapiens
  misc_feature: GYAE6OF01EHGQ4.49.26.C04.1.454.CMB.1.raw
  modified_base (692)..(692): a, c, t, g, unknown or other
  misc_feature (692)..(692): n is a, c, g, or t
tcagagtcgagagacacgaccggtgctcgatttagtctagcgactttgggttggggggaagaggaagactgacggtccccccaggagttcaggtgctgggcacggtgggcatgtgtgtagttttgtcacaagatttggctcaactctcttgtccaccttggtgttgctgagcgttcgggttttccttgttgtactttaagtttaaaggtcgtaccgagtgtgaagtggacgtaggtttgggaggtaagtccggtagggggtaagttcgggtaggtagacggtccgggttacgggggggtcccctaggtaacgtccgttccgttcccgtggttacgaccgaacggttccctaccggtggtacttactaactttcgttagtaagtacgttattaacgtcgtacctacgtgacctaacggtcggtaccgttaccgaaggtaaccggtccgggtaaccgggggtaacggttccggtagggtacggttccgggtttccttacgtttacgttttaaagggttacggttaggtaaggttcgggtttaacgttaactaccgtaaaccgtttacgtacgtcgtacgtagtaccttagttggggttaacggaggtacttacctaccgtaaccttactacgtaacggtaacgacaaacgaaccgtagtaaccaaccggttaacctgtaaacgtctaacggtanaactaaagtcaacgttagaccgtaagtaacggaccgtacgaaacccgttccgtacccgttaccttaacggtaccgttacgtaaggttaaccaaacggttaaacttccggttaaacggaaaccccttccgtttaaacccg

SEQ ID NO: 70281 - DNA, 892 bp, Homo sapiens
  misc_feature: GYAE6OF01DF73U.49.26.C04.1.454.CMB.1.raw
tcagagtcgagagacacgaccggtgctcgatttagtctagcgactttgggtttggggctctgggaaaggagccccagccctgagattcccaggtgtttccattcggtgatcagcactgaacacagaactcaccatggtagtttgggctgagtcgttgggtttttccttggtttgtacttaagtttttaaaaggtcgttaccgagtgtagtaagtgcgtagttggtaggagtcggtaggggagtcggtggtagcggccggttcgggggtcccctaggaacggtaccttccgttccgttgtcgtaccgacgtccgttcgttcggtactttacgtacgtttcgtttaggtaattagttaactttaacgtcgtaaccctagtacgtacctaacggttacggtaaccgtttacccggacggtaaaccgggtccgggttaaaccgggggtaacgggttccggttagggtaccgggtttacggtttcttaccgtttagtttaaacggtttaggttgggtaagttcggtagttaactaccgtaccttaactagtcggtacgacgtacgtacggtaggtaacgggtaacggtacttaccttaccaacccgttcgtaacccgacgaaaggtaacccaaacgtaaccgaacggtaaccctaaaccgtaaacccttcccgttaagtaccctaacggtacaaacgtaaccgttaacgaaccttaccggtaccgtaggtaaaggggttacggaaccgtaaacccggtaccttaccccggttacccttaaaccgtaccgtttgaaccggtttaaaacccaaaagggtttaaacgttaaccggtaaccggtaccctaaacccgttactttaaaccccgtttagtttaccccgaacgtcggtacccggg

SEQ ID NO: 70282 - DNA, 848 bp, Homo sapiens
  misc_feature: GYAE6OF01A0CKV.49.26.C04.1.454.CMB.1.raw
tcagagtcgagagacacgaccggtgctcgatttagtctagcgactttgggtttggggggaagaggaagactgacggtcccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtggggggtccctgagactctcctgtgcagcctctggattcattctttgatgtaattatcggacctagttcgctacgtggtacttcccggtacgaaacgggtccggtacccggggggtaaagggttccggtagggtagggttcggggttccttacgtttaccgtttaagtttaaaggttgggggtaacgtttcggggttagggttaacttacccgtaacccgttaaacgttaagtcggtacgtaacggttaccttccgttagggtaacgggtaaacgggggttcccttaacgttaccccaaacccggttcttacccgtacccggaaggtaaacggtaaacccaaacgtcgggtaaccaaacgggtaaaaccccctttcccgggttaaagttaaccgttaccgtaacggaaaccgttaaaacggttacggaaaccttaccggttactaaccgggtaagggaacgggtttaacggaacccggttaacccgtacccgggttaccctttacggtaaacccggtttacgtacgggttaacgtaaacggttaaaaacggttcccgggtttaaacggtacccgtaaaccctttaaaccccgg

SEQ ID NO: 70283 - DNA, 805 bp, Homo sapiens
  misc_feature: GYAE6OF01DL61P.49.26.C04.1.454.CMB.1.raw
tcagagtcgagagacacgaccggtgctcgatttagtctagcgactttgggtttggggtgggctcaggaggcagagctctgggaatctcaccatggcctggaccctctcctgcctccccctcctctactttctgcacagtctctgacggcctcctatgagctgacacgacgccacccgtggtcgtcggtcgtccccgaggaacaacggccaggactaacctgctcgtggagatgactagttacgaaacctaaaaaattgtacgttcgtttaggttacggtaaccgaagtaaacggaacgccgacggaccaccggtccccgttgtcgtttacgaacttacgttaaattttaacgtaaacgttacgtttacggaacggtccgggtaccttacgggaacccgggtacccgtaggacggtacgttacttccgttcggtacggtcctacgtacgctacgacgtacgaacaacgtcgtactacgttacgactacgtcggtaggtacgggacgggtccgggagaacgggacgggtaacgtacggtacgtacgttaacttaagtttccgtagtaccgtaacgtactaacgcgtaacgtacgtagggttaccggttcgtaacttaccggtttacttcgggttaccggtttacggtaccggggaccgggtacggaaccgtcgggttaccgtacgggtacccgttacggtaccggtaacccggaacggtaccccggaacgggttcccccgaaccccgggttacccccgtttacgggcccctttaaccccttccgggtttcccccgttaaaccccccc

SEQ ID NO: 70284 - DNA, 995 bp, Homo sapiens
  misc_feature: GYAE6OF01B09PR.49.26.C04.1.454.CMB.1.raw
  modified_base (234)..(234): a, c, t, g, unknown or other
  misc_feature (234)..(234): n is a, c, g, or t
tcagagtcgagagacacgaccggtgctcgatttagtctagcgactttgggtttggggtggtctcaggaggcagagctctgggaatctcaccatggcctggacccctcctcctgcctccccctcctcactttctgcacagtctctgaggcctcctatgagctagacacacgcccacccgtcggtgtccggtcgtaccccgaaggaaccgaaccggccaaggactaacctgctcgnggagatcgacgtagttaacgaaaacctaaaaaaattcgtgtcgtttaggttaacggtaaccgaaagaaacggtaacgtaccggacgggtacccggaaccggggtccccggtttaggttccgtaccgttaccgtaacgtttaccgtaaggtacggtaaaacccggtaaaccggaaaaccggtaaaaacccccggtaccccccggtacccggggttaccttaccccggtaggaaacggtacgtttaacctttccgtacggtacccgtacccgtaccccgtaccggtaccgtaccgggaacctacggtaccggtacccgtacgtacgtaactacgtacggaaccggggcccgggaccggaagggtacgggaaggtacggtaggtaacgggttaacgtaaccgttaacgtttacggtttaccgttaacctaacccgtaaccgtaacgtaacccgtaaccgtaacggtaaaacgaaaccgttaaccgaacggtaaaacgggtaagggttaaacgggtttaacgggttaacccggggaacggggtaaacccggggtaaacccggttaaccggtacccggttaacccggtaaaccccgggttacccgggtaaccggtaacccggtaaaccccgggtaaccccgggtaacgggttacccccgtcccccggggtaccccccgttacgggttaaccccccttaccccggtttcccgtttaccccccgttacccccctttaaccccccgttcccgtttaccccgttcccccg

SEQ ID NO: 70285 - DNA, 927 bp, Homo sapiens
  misc_feature: GYAE6OF01AGP6Y.49.26.C04.1.454.CMB.1.raw
tcagagtcgagagacacgaccggtgctcgatttagtctagcgactttgggtttggggtgggctcaggaggcagagctctgggaatctcaccatggcctggaccctctcctgcctccccctctctactttctgcacagtctctgacgtcctctagtcgagtctgactacgacgccctaccggtcggtcgtcggtccgtacccgaaggtaaccgaaaccggcgtaacggacttaaccgtcgtctacgtaggacgtagtcgtactaggttaacgaaaacctaaaatcggttacgtcgtttacggttaacgaccgtaacggaaacgtaaccggttcgaaccggtacccgtcgggttacccggttgttacgtactaccgtacttacgacgtaacggaccgaacgtaaaaccggtacccggtaacccggttcgggtacccgtacccggtaggtaaccggttacgttaccgttccgtaccggttaccgtacccgtcccgtaacgtaccgggaaccgtacccgttacgggtacccgtacgggtttaaccgtaacggtaacttccgggacgggtaccggggtacccggggtacggtaacgggtacggtaacggtaagggtacggtaacgggttacgttaagttaccgtttaacgttacgttaccgtaaccgtaacctaacggtaaccgtaaccggtaaacggtaacgtaaccgtaacgaacggtaacggttaaacggttaacggttacggggttaccggaacggggtaaccggtaaaccggtacggttcggtaaccgtcccgggttaaggtaccggtaccggtaaccggtaacccggtcccggtaccccgtacccggggttacctaccccggttaccttaccccggtttaaccgttccccgttaaaccccgtcccgtttccgttacccgttacccg

SEQ ID NO: 70286 - DNA, 742 bp, Homo sapiens
  misc_feature: GYAE6OF01BUTY1.49.26.C04.1.454.CMB.1.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
  modified_base (314)..(314): a, c, t, g, unknown or other
  misc_feature (314)..(314): n is a, c, g, or t
  modified_base (407)..(407): a, c, t, g, unknown or other
  misc_feature (407)..(407): n is a, c, g, or t
tcagagtcgagagacacgaccggtgctcgatttagtctagcgactttgggtttggggtgggctcaggaggcagagctctgggaatctcaccatggcctcggacccctctcctgcctcccctcctctactttctgcacagtctctgacggcctcctatgagctagacacacgcccaccctggtgtccgtcgaccccgaggaacaaacggccgaggactaacctgctcgagagatgntagttanaaacctaaaaaatgtagtcgttacgttacggaacgaagaagtaacgtaccgacgggaccgacggtcccggtnttcgctaccatacgtatacgaaccgaacaaacggtaaaaccgaccccgtacggacgtacccgtagtaacggaatacttcgttcgacggtaccnccgtaccgtacggaacggaaccctggtaccggacctacgttaggacttaacgccgacgggaccggcgaacgggtggaacggtagtcgggtaaggtacgtacgtaagttacgttaacggttaaccttacgaaccgaacgaacccgtaacgtaacgtaaacgtaaactaaccgaagaaaccggaaaggtaacgtaacgggttacgggaaccggtaaccgggaacaacggtaccgtacggtaaccgtaccggtaacggtaccgaacgaacccggtacgccgtaccgttaccccgcgtaccctacgtccgttaccctccggtaccctccgtccctaccg

SEQ ID NO: 70287 - DNA, 471 bp, Homo sapiens
  misc_feature: GYAE6OF01BQI2V.49.26.C04.1.454.CMB.1.raw
  modified_base (81)..(81): a, c, t, g, unknown or other
  misc_feature (81)..(81): n is a, c, g, or t
  modified_base (165)..(165): a, c, t, g, unknown or other
  misc_feature (165)..(165): n is a, c, g, or t
  modified_base (169)..(169): a, c, t, g, unknown or other
  misc_feature (169)..(169): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (416)..(416): a, c, t, g, unknown or other
  misc_feature (416)..(416): n is a, c, g, or t
  modified_base (436)..(436): a, c, t, g, unknown or other
  misc_feature (436)..(436): n is a, c, g, or t
  modified_base (448)..(471): a, c, t, g, unknown or other
  misc_feature (448)..(471): n is a, c, g, or t
tcagagtcgagagacacgaccggtgctcgatttagtctagcgacttttgggtttgggggagatgcattgaccaaaaaaatntgcttgttggaccagaagaagtcaggccacggcccggtgttgctcatctatgacgacaagaaaaccgccctcggctcctgaganttcngtgctcacctgaggtccagtcgctacggttnacttancgaggccgggtccgngggtaggagtagtacggaaggtcgtactaacgttatttcgtacctcgaacaacggtacaaccgtaagtaagaaaacttccaggaagtagaaacttggtcggaacggtagacctagctcgacgttcaggtcacgcccaggttcctaccgcccagtcctacctcgttccacccgttcctccgttcgcttacgtctancgcggtacggcggaatacgnaacggcatacgnnnnnnnnnnnnnnnnnnnnnnnn

SEQ ID NO: 70288 - DNA, 846 bp, Homo sapiens
  misc_feature: GYAE6OF01EEZDZ.49.26.C04.1.454.CMB.1.raw
  modified_base (281)..(281): a, c, t, g, unknown or other
  misc_feature (281)..(281): n is a, c, g, or t
tcagagtcgagagacacgaccggtgctcgatttagtctagcgacttttggggtttgggggtgggctcaggaggcagagctctgggaatctcaccatggcctcggacccctctcctgcctccccctcctctactttctgcacagtctctggacggcctcctatgagctagacacacgccctacccgtcggttcgtcggtccgtccccgaaggaaccgaaacggccgaaggaacttaaccgtcgcctcgtaggagatgactacttacgaaacctaaaaaattntcgtcgtttaggttacggtaacaaggtttaagaacgtcgacgggccgaccgggtccccggttgtcgctctatcgttagtacggaaccgtaaacgaaaccggtaaaacccggtacccccggtaccgggtacctacccgtaggaacggtattacgttcctacggtccgtccctacccgaccgtccggaacggtacctacggtccggtaccttacggtacgtaccgtacgtaccgggacggggtcccgggtacccggtagggggtaggaacgggtaggtacgggtaaggtacgtacgtttaacttacggtttacgtaacctacgaacctaacgacctaacgtaagtaaacgtaaacacgtaaacggaggtaacggttaacgttacggggtacgggaccgggtaacggaaaccgaacgttcggtacccggtacccggtaacgtaacggtacccgaaccgggacccgggtaaccggtccccgttaccccgtccccccgggttcggttaccctaccccggttttccccgttaaccccgttacccccgtcccccttccgttaccctccccgg

SEQ ID NO: 70289 - DNA, 868 bp, Homo sapiens
  misc_feature: GYAE6OF01AXIEW.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtacctagaagaagtcaggccaggccccggtgttcgctcatctatgacgaacacggaaaaacgtcccgtccgggactcccgtagagagattcgtctggctaccacctacgacgggaccaagtcgggaccctaacggttcgaacgttaactcgaacgggtccggggacccaaggggttcggaacggggtattacgggaaacgggttcggtaaaccttaaccgttaacgtttacggttttaaactaccgaaaccccgtaaaggtaaaccccgaaacccgtaaagggtttaaacggaaaaaaccttccgaaaaccggtaaacgggtaaacgggggtaaaaacttttaaacgggtttaacccgggggaaccggggtaaacggggggtaaaaccccaaaacgggttacccgttaacggggtaaacccccgttacccggtttaaacggggtaaccccgttaaacggggaaccccccgttaaaaggggtccccgttaaccgggtaccccccccccggttacccgggtttaacccgtaaaccccggtttacccggtttacccggtttttaaaccccccccctaaccccccggtttaaccccccgtttcccgtttaaacccccccgg

SEQ ID NO: 70290 - DNA, 933 bp, Homo sapiens
  misc_feature: GYAE6OF01CIOSZ.49.26.C04.1.454.CMB.1.raw
  modified_base (255)..(255): a, c, t, g, unknown or other
  misc_feature (255)..(255): n is a, c, g, or t
tcagagtcgagagacacgaccggtgctcgatttagtctagcgactttgggtttggggtgggctcaggaggcagagctctgggaatctcaccatggcctggacccctctcctgcctcccctctctactttctgcacagtctctgagcctctatgagctgacacacgccgaccgtggtgtcggtcgtcccaggaccgaaacggtccaaggtactaaccgtgctcgtggagtatgctagttacgaaacctaaaaattntcgtacgtttggtacggtaaccgaaggtaaggtaacgtcgacggtccgacgggtcccggttagtcgctacgattcgtagtacgaaccgtaacaacggtaaacccgacccgttaccgggacttacccgtaggacgagttacgttccgtacggttcggtaccctccggtaaccctcggtaaccggggtaccctacgggtaccggtcccgtaacggtttaccggtaactttaacgcccgggtaacggggtaccccggggtacccgtaaggggggttacggtaacggggtacggttaacgggttaaaccggggttacgttaaccgttaaccggttttaaacgtttaccgggtttacctacccggtaacgtaaccgaaacccggttaaccgaaacgttaacggtaaaccgtaccggtaaggaaacgggtaacgggttaacggtaaccgggtttaccgggggaaccgggtaaccgggtaacccgttaaacgggtcccgttaaccggtaacccgggtttcccgggtaaggttaccccggtaaaccgggacccccgggtttaacggaccccccgggttacccccggttccccggtttacccccgggacgtttaacccccgtttcccggttaccccccggttacccccgttaacccccgttttcccgttaacccccgtttaccccgg

SEQ ID NO: 70291 - DNA, 491 bp, Homo sapiens
  misc_feature: GYAE6OF01C03KN.49.26.C04.1.454.CMB.1.raw
  modified_base (286)..(286): a, c, t, g, unknown or other
  misc_feature (286)..(286): n is a, c, g, or t
  modified_base (467)..(491): a, c, t, g, unknown or other
  misc_feature (467)..(491): n is a, c, g, or t
tcagagtcgagagacacgaccggtgctcgatttagtctagcgactttgggtttggggagatgcattgaccaaaaaaaatatgcttgttggtaccagaagaagtcaggccaggccccggtgttgctccatctatgacgacaagaaaaccgaccccgtccgggatcccgtgagagtattctcgtggcctcccacctcgacgggaccagtcggccctacggtttgacctatccgacgggcccggggcccagggtggaggagtaggaaggtgacttacttattcgttacnccaccagaccacgtagtagaaatcacgagaaggtaatagtcggacggacggaccagcgtcgaccgtcgtaggtcacgacccgaggtcctaccgtcccccgtcggtcctacctccctccgtcccctaccttccctcttcctcctcgcttcgtcgcggcggtcgtggacgacggcacagtagnnnnnnnnnnnnnnnnnnnnnnnnn

SEQ ID NO: 70292 - DNA, 676 bp, Homo sapiens
  misc_feature: GYAE6OF01AKZBH.49.26.C04.1.454.CMB.1.raw
  modified_base (244)..(244): a, c, t, g, unknown or other
  misc_feature (244)..(244): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggaccaaacggccaggactaacctgctctggagatgcattcgaaccaaaaaatntgtcttgttgtaccagaagaagtcacggccacggccccggtgttcgctcactctatgacgacaagaaaaccgccgtcggtactccgtagacgagtattcgtctggcctccgcctcgacggacctagtcgaccgtacggttgacttagtccgaggtcccggggacccgtagggttcgggaaggacgttaggaaggtcgtaacgttaaccttacgtttacgttaacctaccgaaccgacgtaaccgtaaccgtaagtaaacgaaccgtaacaacgaagtaacggtaacgtaacggttaccgggacggaacggaccgtaagtccgtacggacccggttacgtacgggtaccaccggacccgtaacggtcccgtacccggtcccccgtacgtacctacgttcccgtccttacccccgaccccttcgtccttacccg

SEQ ID NO: 70293 - DNA, 428 bp, Homo sapiens
  misc_feature: GYAE6OF01A5UTB.49.26.C04.1.454.CMB.1.raw
  modified_base (414)..(428): a, c, t, g, unknown or other
  misc_feature (414)..(428): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggcccaggtggaggatgaaggtgactatattgttactcaccagacacagtagaaatcacagagaatatcggcggaggaccaagctagaccgtccgtaggtacacgacccaaggcctccgccccctcggccactcctcgttccccaccctcctctctctcgactcgtgacggcggtctcggacgaagggccacgatacggnnnnnnnnnnnnnnn

SEQ ID NO: 70294 - DNA, 744 bp, Homo sapiens
  misc_feature: GYAE6OF01CQY2K.49.26.C04.1.454.CMB.1.raw
tcagagtcgagagacacgaccggtgctcgatttagtctagcgactttggggtttgggggtgggctcaggaggcagagctctggggaatctcaccatggcctcggacccctctcctgcctccccctcctctacctttctgcacagtctctggacggcctcctatggagctgacacacgcccaccgtcggtgtcggtccgcccgaaggaccgaacggccaaggactacctcgctcgtggagtatgactattacgaaaacctaaaaattcgtacgtacgttggttacggtaaccgaaggaacgtaacgtcgacggccggaccgggtccggtcgttcgcctacgtattacgtagtacggaaccgtaacgaacggaaacccggtccggtaccggacctaccgtagacgtagttacttcgtcgtaccgacccgtcctaccgtacgaccggtaaccgcggtacggtccgtacgttacgacgtacgacggacgggaccggggacgtgggacgggtacgtaagtacgggtagttaccggtacttaagttacttacgtaccaccgaactaacgtaccgaactaaggaacgtaactacgaagaagggtaacggttagtaccgggtaacgggacgggaacgttaccggactacgggtcctaccggttaaccggcgtccggaacgccgtacgggccctacccgggtcccctcggtaccctcttacccgtaccgttcccccaccgtcccttagtcccg

SEQ ID NO: 70295 - DNA, 762 bp, Homo sapiens
  misc_feature: GYAE6OF01ET0AS.49.26.C04.1.454.CMB.1.raw
  modified_base (127)..(127): a, c, t, g, unknown or other
  misc_feature (127)..(127): n is a, c, g, or t
  modified_base (542)..(542): a, c, t, g, unknown or other
  misc_feature (542)..(542): n is a, c, g, or t
  modified_base (615)..(615): a, c, t, g, unknown or other
  misc_feature (615)..(615): n is a, c, g, or t
tcagagtcgagagacacgaccggtgctcgatttagtctagcgactttgggtttgggggctctgggaaaggagccccagccctgagattcccaggtgtttccattcggtgatcagcactagaacacanaactacaccagtggtagtttgggctgtaggtcttgggtttttccttgttgtacgttaatttaaaaggtgtacctagtgtgaagtcgagtaggttggagtaacgtgggtaggggtacgtcggtaggtacgacggtccgggtcggggtcctagtacgtctctcgtgtacgacgctccgtacgtcgttactactattcgttagtaagtagtacttaatccgactacgtcgaccgttacgtacgttaccgtccgtaaacggtaaccggtggaaaacgggggtcttcgggtaaacgtcgggttcgttactttccgtttagttaaaactttgggggtaaatgttcgggttaatactacccgtaaccgttagttaacgtctaaggaacgttaccgtggttagtaaacgggttccgggtaacnttacgtacccgtaacgtactacccgtaacgtaacgaaccgaacgaacgaaccgtaacgtaaaccgtaccctancgtaacgtactacgtacgtaacgtaacgtaacgtaacgtacgtacgtaacgtacggtacgtacgtacgtaccgtaccgtaccttacgtaacgtacgtagtaacgtaacgtacgtacgtacgtacgtacacctacttcgtaccgtacg

SEQ ID NO: 70296 - DNA, 733 bp, Homo sapiens
  misc_feature: GYAE6OF01A8BAL.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgcttattttaaaaggtgtccagtgtgaagtgcagttggtggatcgtgggggagtcgtggtagagccgtggggggtcctgagactctcctgtgcagcctcgtggattcattcttttgatgtatttatcgccatgcacgtggactccgtcaacggccggtaccgggggtaagggtcgtgggtaggttcgggtcttcttactttaagtttaagttggggtagttaggtggttactccgtaaccttaacgtagtgacctaagtccttacggttggtacgggtaaacggggttcgtaacgtttccaaccctacttcccgtaacgaacggtaaacgaaccaaacgacggaactaaccgtaaacccttccccgtaaggttacttaccgtagaacctaaagtccggtaaactaccgttacgtaacggaagggttaagggttaggaccggtaacccgtaccccgttacctttaccgttaacccgttaggttaccggtaacgtaaagtaaacggttacgttaaccgggtaccaacccgtaaccttacttaacgtttacacccggtcgtacccgggg

SEQ ID NO: 70297 - DNA, 707 bp, Homo sapiens
  misc_feature: GYAE6OF01AVNRL.49.26.C04.1.454.CMB.1.raw
  modified_base (275)..(276): a, c, t, g, unknown or other
  misc_feature (275)..(276): n is a, c, g, or t
  modified_base (424)..(424): a, c, t, g, unknown or other
  misc_feature (424)..(424): n is a, c, g, or t
  modified_base (490)..(490): a, c, t, g, unknown or other
  misc_feature (490)..(490): n is a, c, g, or t
tcagagtcgagagacacgaccggtgctcgatttagtctagcgactttgggtttgggggcgtctgggaaaggagccccagccctgagattcccaggtgtttccattcggtgatcagcactgaacacagaactcaccatggagttgggctgagcgtggttttccttgttgtcttaatttaaaaggtgtccagtgtgaagtgctaggttggtaggaactcggtggggtagtcggtggtacgacgtccggtcgggggtccctgagctctccgtgtcgcnnccgtcgtaggtattcatttcgttagtatagtattacgtcgacctagtcgaccgtagtcggtactccgacgtacggccggtaccgggggtacgtgtagggtacggtcggtcttacgttagttaattacggtggtacgtggtagtacctnacctatgcgtcacgtactgtaggtagacggtctagtccacgtatccgacgtaacgacgaacgtaanacgaacccgtaactacccgttaccgtagtactacgtacgtaactaagtagaacctagttaccgtacggtaggttaacggaccggttaaccggacccgttacccgtaacgttacccgtagttaacgttaacggaacgtaaacgtaaaacggttcgtacccgtaaaccgtaccgtaacctttacccgttactacccggtaacccgtcggtaaccccggg

SEQ ID NO: 70298 - DNA, 609 bp, Homo sapiens
  misc_feature: GYAE6OF01E1SCT.49.26.C04.1.454.CMB.1.raw
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
  modified_base (599)..(599): a, c, t, g, unknown or other
  misc_feature (599)..(599): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttcctgttgctattttaaaaggtgtccagtgtgaagtgcagttggtggaatcgtgggggagtcgtgggtagaggccgtgggggggtccctggacgactctcctgtgcagcctctggattcattctttgatgtattatgccatgcactggatccggtacaaggccgtccggggaaggtctgggagtggtctcttcttattagtggntggtgtatcactactntcgnagctgtggngaagggtcattcactntccgtcagtaacgactaacacgtacaacgtaacctcccggttatacttcgtacgacgtaaatcgaaactacgtcctaagagtagggtacgaacgtaccctacccgtcctttaacgtacctaacgtaggtacgaaactaaaggttacttacgggaaccaacctaaccgttaaccgtttaattcccgtaaacncggtaccggg

SEQ ID NO: 70299 - DNA, 747 bp, Homo sapiens
  misc_feature: GYAE6OF01ARAS5.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttcctgttgctattttaaaaggtgtccagtgtgaagtgcagttggtggaatcgtgggggagtcgtggtagagccgtggggggtccctgagactctcctgtgcagcctctggattcattctttgatgattatcgcctagtgcacgtggacttcccgtacaacggccggtaccgggggaaggttccgtagggtacggttcgggtccttcgttacgtttaacgtttaaggttaggggtacgttgggttaggttaacttaccgtaacccgttaacgttacgtggtaccgtacggtacttccgtagggttacgggaaacggggttcgtaactttccccgaacctaacgttccccgtaccgaacggtaacgaaccaaacgtacgtacccgaaacgttaaaccccttccccgttaaggttaccttaccgtaggtaacccttaaaacgtccggtaaactacggttaccctaggaacgggtacggtacggaacgtaccccgtaccggttcccttacggtaccgtacgttgggactaaacggtaaacgttaggttaccgggtcctaaacccgttaccg

SEQ ID NO: 70300 - DNA, 761 bp, Homo sapiens
  misc_feature: GYAE6OF01A2MJQ.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagtcgttgggttttccttgttgctattttaaaaggtgtccagtgtgaagtgcaggttggtggaagtcgtgggggagtcgtggtagaggccgtggggggtccctgagactcgtcctcgtgtcagcctctggtattcattcttggatgtacttatcgcctatcgctacgtggacctccgtacgaacggtccggtaccggggtacgggtcgtggtacggttcgggttctacgttactttaagttacggttgggtagtcggtgtactcgtaaccttactagtgacgtacgtacgtccgttaggtaggtaagggttacctaacgtttaccaaccctacgttcccgtaacgtaaacggaacgtaaaccgaaccgtaacggtaacccgaaaccgttaaaccctttccggttaacgttaaaccttcgaacggtaaccaaaggttacgtaaacgtccgtacttaacgggacgggtaacggttacggaacggtaccctaccccggttaccgttactaccggttaagtcgggtaacctaaacgtaaaggttcggttaacccggaaccttaacccggtaaccttacccgttttaaacggttcccgaaacccggttgaaccgggg

SEQ ID NO: 70301 - DNA, 953 bp, Homo sapiens
  misc_feature: GYAE6OF01DSNAJ.49.26.C04.1.454.CMB.1.raw
  modified_base (347)..(347): a, c, t, g, unknown or other
  misc_feature (347)..(347): n is a, c, g, or t
tcagagtcgagagacacgaccggtgctcgatttagtctagcgactttgggttgggggctctgggaaaggagccccagccctgagattcccaggtgttccattcggtgatcagcactgaacacagaactcaccatggtagttgggctgagtcgttgggttttccttgttgtacttaatttaaaaggtgtccgtagtggtgaagtgcgtaggttggtaggaacgtcgggtagggggtagtcggtggtacggacggtccggttcgggggggtccctaggacgtacgttccgtccgtcggtcgccgtacgtcctccggttgtattcctatttcgttggattgtaaatttcncggtaccctatccggtacctacggttacgggtaccgttacccggttaaccggtaacggggtacccgggggttaacccggggggaacggggttccggtttaggggtaaccggggtttcccgggttacgtttaccgttttaaggttttaaaccgggttttaacgggttttagggggtaaaccgttttgggggtttaacggttaccttaaccccgtaacgtttaaccgttagtacccggtacggtaagttaccccggtttagtacgggttacggggttaaacggttaaccggttaccttaaaccccgtccccgtaaaccgtttacccgggaccgttaacggggaaaccgtaaaccgtaaacgggaaacctaacccggttaaacccgtttaaaccccgttaaccgtttacgtctttaacccggaagtaaacgtaaccgttaacggaacccgttaacgtccgtaacggggtgttaagggacccgtaactaccccgttacgtttcccgttaactacggtaagtaaccgtccggaaaatttaacccggtacttacccggaaacgtacccctacgtttaaccccgtttatccaaacccggttggacccccgggg

SEQ ID NO: 70302 - DNA, 906 bp, Homo sapiens
  misc_feature: GYAE6OF01AS76H.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcgttgggttttccttgttgtcttaatttaaaaggtgtccagtgtgaagtgctaggttggtgaagtcgtgggggagtcggtgggtagacggtccggtcggggggtccctggacgtaccttccgtccgtgtcgcctacgtcccttcgtaggtactttacgtatttcttttaggtattaggttaatttagtccgtacccgtaagttccggtaccgtaaccgttacgggtaaccgtttacccggtaaccggtaaacggggtccccggggttaaccgggggggttaaacgggttcggttacgggggtacgggtttcggggtttcctttacgttttaacgtttaagttttaaggtcgggttaggttggggttaacgttacccgtaccttaaccgttaacgttacgtaccggtacgttaacgttccgttaaggttacggttaacgggtaacgggttacctacttaacccgaaacccgtttcttacctaacggtaaacgaaacccgtaaaccgaaacgaaacggtaaacccgtaaaacccgttaaccccgttacgttaacgtttacccgtaagttaacggaaaaccttaacgttaacggaaaccgtttacctacggtaaacggtagggtaacgtacggtaaaccgtcccgtaacccgttccttaacgtaccgtacgtagtaacggaaaccggttaaacgtccggttaaaggaacccctaccgtaaccctttagttaccttaacccggcgtaacccggtcccgg

SEQ ID NO: 70303 - DNA, 1063 bp, Homo sapiens
  misc_feature: GYAE6OF01ATWLY.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggtagtttgggctgagtcgttgggttttccttgttgtacttaagttttaaaggtcgtccagtgtgaagtgctaggttggtaggaagttcggtggggtagttcggtaggtaggacggccggttcggggggttccctaggacgtacctccgttccgtggtcgacgtacgtccgttcgtgtacttctatttacgtttgtattagtaacgtttagtccggacctaagtccgtaaccgtacgttacgggtaccgtttacccggttaacgaaccggggttaccccggggttaccggggggtaaacggggtttccggtaagggggttaacgggtttcccgggtttaccttttaaccgtttttaaccgtttttaaaagggtttaaggggttttacgggggttaaagtttcggggttaacgtttaaccgtaacccgtttaaacccgtttaaacgttacgtacgaaccgttacggtttacctttaaaccgggtttaggggtaaacgggttaaccgggtttaaccgtttaaccgtttaaccccgtaacgtaaccccgtttaccgaacccgaacgggttaaaaccacggtaaaccgaccggtaaacccgtaaaacccgtttaaccccgtttacgtaacggttacccttaacggtttacgtaaaaccgtaaaaccggtttagtaacccggtaaacccggttcggttaaacgggttaaaccgggtaacggggaaacccggttaacccccggtaaaccttttacccccgtaacccggttttaacccccaaacggtttaaacccgggtaaggtttaaaaacccgttaaacggttaaaacccggtttaacgttaacccccgggtaacctttaaaacccgtttacccttttaaacccggtttaaccgttacccgttaaacccgggtacccggtaacccccggggg

SEQ ID NO: 70304 - DNA, 815 bp, Homo sapiens
  misc_feature: GYAE6OF01BG8Q7.49.26.C04.1.454.CMB.1.raw
  modified_base (711)..(711): a, c, t, g, unknown or other
  misc_feature (711)..(711): n is a, c, g, or t
  modified_base (721)..(721): a, c, t, g, unknown or other
  misc_feature (721)..(721): n is a, c, g, or t
  modified_base (788)..(788): a, c, t, g, unknown or other
  misc_feature (788)..(788): n is a, c, g, or t
tcagagtcgagagacacgaccggtgctcgatttagtctagcgactttgggtttggggtgggctcaggaggcagagctctgggaatctcaccatggcctggacccctctcctgcctcccctctacactttctgcacacgtctctggacggcccttactagtgacgtcgtacgacacacgaccctaccgtcggtcgtcggttccgaccccgaaggaaccgtaaacggccgaagaacttaaccgtgaccttagtaggaatagtcgactaacgttacgaaaactaaaaaatgtacgtacgtttagttaacggtaacgaagaacgtacgtacgacggacccgtaacgggtccggttaggttctctaactacgttaccggtaataccgggaaactaaacccgggaaaacgtaaaaaccccggtcccggttaaccggaaccgtttacccgaaagggtacgtaacggttaacttccgtttacggaccgttacctacccgtaaccgtaacgggacgtaacccggtacacggtacccgttaacggtaacgtactacgtaacgggaccggtacccgggaaggaccggtagggaacgtaagtaacggagtacgtaagttacgtaacgtttactaacgaccgtaacgtacgaactaaccgagaaaccgtaaccaagaaccgtaaggaagttaacgtacggtacggaccggtacgaaccggtaanacggtacccnccgggtaaaccttagggaccacccgaaccgggcttaaccgggcctccccggtagtccaccgtttacncccgttaccccaccgtttcaccttccg

SEQ ID NO: 70305 - DNA, 726 bp, Homo sapiens
  misc_feature: GYAE6OF01ARFWE.49.26.C04.1.454.CMB.1.raw
  modified_base (275)..(275): a, c, t, g, unknown or other
  misc_feature (275)..(275): n is a, c, g, or t
  modified_base (447)..(447): a, c, t, g, unknown or other
  misc_feature (447)..(447): n is a, c, g, or t
  modified_base (563)..(563): a, c, t, g, unknown or other
  misc_feature (563)..(563): n is a, c, g, or t
  modified_base (685)..(685): a, c, t, g, unknown or other
  misc_feature (685)..(685): n is a, c, g, or t
tcagagtcgagagacacgaccggtgctcgatttagtctagcgactttgggtttggggtgggctcaggaggcagagctctgggaatctcaccatggcctcggacccctctcctgcctccccctcctctactttctgcacagtctctgacggcctcctatgagctgacacacgcccacccgtcggtcgtcgggtccgtccccgaaggaaccaaaccgggccgaaggaactaaccgtgcctcgtggaagtatgactagttacgaaaacctaaaaaatnttagtcgtttaggttacggtaacaaggtaagtaacgtacgacggacccgtacgggtccccgttgttacgcctacacttcctagcgtaaacgaacgaaaccggaaacccgtacccgtacggacctccgtagagtagtacttcgtcgtcgacctaccgaccgtcggaccggacncgtcggacgtacgtactacgacgtacggccgggacgggaccgtagggaggacgtaggaggtaggtactactaattacgttacgtacctacgaacacgtaacgctaaagaacaacgngaaccggtaggtaacgtggttaacggcgggtaaccgggaagacgtaaacgttccggaaccggtaacgtccgacggtacgtaccggacccgtacggcccgacccggttccccgaaggttcccnccgtttccgtaccccgttcccctaccgttccctgttccccg

SEQ ID NO: 70306 - DNA, 668 bp, Homo sapiens
  misc_feature: GYAE6OF01BU5OG.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctggagcttgggttttccttgttgcttattttaaaaggtgtccagtgtgaagtgcagttggtggaatcgtggggagtcgtggtagagccgtgggggtccctgagactcctcctgtgcacgccttctggtattctattcgtttgatgtatttatgcctatcgcacgtggactccgtacgaaggtccggtaccgggggtaacgggtcggtgggtaggtgggttcttcttacgtttagtttagtggtagtggtagtactcaccttactagtgacagtactgtcggtaggtaacggggtctacttccaaccctacttcctacgaacgaactaaccaacacgacaacgaacccttcctagtactcgtacgaactaatcgaactacgttccgtagaggtacggtacgaaccgtacccgtacccgtacctttacctaccttacgtacggtacaaacggtaaagttaccgttaacgggtaccaacccttacccttaacgttttagttaccctaccgtcggtaaccccggg

SEQ ID NO: 70307 - DNA, 609 bp, Homo sapiens
  misc_feature: GYAE6OF01CF1Q7.49.26.C04.1.454.CMB.1.raw
  modified_base (81)..(81): a, c, t, g, unknown or other
  misc_feature (81)..(81): n is a, c, g, or t
  modified_base (139)..(139): a, c, t, g, unknown or other
  misc_feature (139)..(139): n is a, c, g, or t
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (568)..(568): a, c, t, g, unknown or other
  misc_feature (568)..(568): n is a, c, g, or t
  modified_base (572)..(609): a, c, t, g, unknown or other
  misc_feature (572)..(609): n is a, c, g, or t
tcagagtcgagagacacgaccggtgctcgatttagtctagcgactttggggtttggggagatgcattgaccaaaaaaaatntgcttgttggtaccagaagaagtcaggccaggccccggtgttgctcatctatgacganaacgaaaacgccccgtcggactcccgtgagagtcttctcgtcggcctccacctacggacgggaccagtcggccctaggttanacttatcgacgggcccgggaccgngggtagggagagtagaggtanacttacgttattacgtacctaccaaccgtaagaccaacgtagtaacaaacncgtaacgaaggtaagtaacgttacgggtaccggggacgggtaacggacctaggtccgtacggtaacccgttcggtacggtaccgaccgaccggtaacgtcccgtaccccggccccgtacgttcctaccttcccggttccttacccccgtccttacccgtccttaccgtccgttaccgacctttcggacgggccggaccgggttacggacggaacggccggtacggtcaagtcgatcagctaggtcggattnacgnnnnnnnnnnnnnnnnnnnnnnnnnnnnnnnnnnnnnn

SEQ ID NO: 70308 - DNA, 715 bp, Homo sapiens
  misc_feature: GYAE6OF01BEILD.49.26.C04.1.454.CMB.1.raw
  modified_base (485)..(485): a, c, t, g, unknown or other
  misc_feature (485)..(485): n is a, c, g, or t
  modified_base (698)..(698): a, c, t, g, unknown or other
  misc_feature (698)..(698): n is a, c, g, or t
tcagagtcgagagacacgaccggtgctcgatttagtctagcgactttggggtttgggggctctgggaaaggacgccccagccctgagattcccaggttgtttccattcggtgatcagcactgaacacagaactcacagtggtagttggctgagtcgttggttttccttgttgtactttaaagttttaaaggcgttccgagttgtagaagtgacgtaggttgggtaggtaacgtgggtggggtagtcgggttaggaggacggtccgggttacgggggtcctaggtacgtaccgttcctccgtggtcgactcgtcctcgtgtattcttacgttcgtttagatagttatttaacgtcgactagtcacgtacgtacgtaccgtaccggtacggacgggtccgggtaccggggtaggtcggtaggtaggttcgttcttagttacgttaagttaggttaggtaggtacggtagtacctaccgtactagttnacgtatactacgtgtaggtacggtagtacctactactaccgtctacgaacgacgaaccgaactaagacgtaacgtaactacccgtacttagtactacgtataacagtaaccgtatcgtagtaagacggtagacgtacgtaccctccgtacgttaccgtagtacgtacgaacgtaagtaccggttaacgtacgactacgtaacttcgtttaacncgtccgacgtacccggg

SEQ ID NO: 70309 - DNA, 880 bp, Homo sapiens
  misc_feature: GYAE6OF01A654B.49.26.C04.1.454.CMB.1.raw
  modified_base (266)..(266): a, c, t, g, unknown or other
  misc_feature (266)..(266): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagtcttgggttttccttgtgcttaattttaaaaggtgtccagtgtgaagtgcagttggtggaagtcgtgggggagtcggtggtagacgcggtgggggtccctgagactctctgtgcngcctcgtggtacttctattcgtttgattagttatttaacgtcgaccctaagttcgtaccgtaacggttccggtaacccgttcccgggtaccgtaaaacggggtccccggggttaacccgggggggtaaaggggtttcggttacggggtaacggggttttccgggtttaccgtttaacgttttaacctttttaaaggtttaaagggttttcggggttaaggtttgggtacggttaaccttacccgttaacccttagtacgtacgaccgtagtaccgtttacgttagggtacgggtaacggttaccgtacttaacccaccttaacgtcccgttaacaacggaaacaacgaaacgtacgtaaaccgaaacggttaaaccccttccgtaagtttacccgacgtaacgtaaaccgtaaagttaccccgaaattccgggtaccgttaaacgggaaacggggtaagtcccgggtaaccgtaacccggtttaccccgttacccggtttacctaaacgttaccggtaacgggtaactaaaacgggtaaacgtttccgggttaaacctaaccgtaaccccttaacggtcccttttaaacggtacccaccccgtaggtacccggg

SEQ ID NO: 70310 - DNA, 802 bp, Homo sapiens
  misc_feature: GYAE6OF01C54IP.49.26.C04.1.454.CMB.1.raw
  modified_base (133)..(133): a, c, t, g, unknown or other
  misc_feature (133)..(133): n is a, c, g, or t
  modified_base (789)..(789): a, c, t, g, unknown or other
  misc_feature (789)..(789): n is a, c, g, or t
tcagagtcgagagacacgaccggtgctcgatttagtctagcgactttgggtttggggtgggctcaggaggcagagctctgggaatctcaccatggcctggacccctctcctgcctccccctcctctactttcngacacagtctctcgaggccctcctatgagctgacacacgccaccgtcggtgtcggtctcccgaaggaccaacggcaaggactaacctgctcgtgagactgtactaattacgaaaccaaaaaattcgtacgtcgtttggttacggtaaccaaggtaaaacgtaacgtacgaacggccggaaccgggtccccgggttggttccggtactacgttaacgttacgtacgtaaggaaccgaaacaaaacggtaaaaccccggtaccccggttacccggggaaccttaccccggtaagggtaacgtaacggtttaaccgttcgttaacccgtcgggttaccctaccgtacccgtaccgtaaccgggaccgtaacgtccggaccgttaacgttacggtaacttacgtaccgacggggaccgggtacccgagggtacgggtaggagttaagggacggtacgtacgttacgttaagtttacgttaaccctacaccgtaaccgaaccgtaactaaacggtaccgtaaagtaccgaaaggacgttaacgtaacgttacgggtacgggaacgggtacggtacgaggtaccgtcggtaccgtacgtacgtccgacgtccgacgtcccgtcccgtaccggccgtacgccttcgtaccctccccgttaccnccgttccgtaccg

SEQ ID NO: 70311 - DNA, 1126 bp, Homo sapiens
  misc_feature: GYAE6OF01DAHTN.49.26.C04.1.454.CMB.1.raw
  modified_base (228)..(228): a, c, t, g, unknown or other
  misc_feature (228)..(228): n is a, c, g, or t
  modified_base (266)..(266): a, c, t, g, unknown or other
  misc_feature (266)..(266): n is a, c, g, or t
tcagagtcgagagacacgaccggtgctcgatttagtctagcgactttgggtttggggtgggctcaggaggcagagctctgggaatctcaaccatggcctggacccctctcctgcctcccccctcctctactttctgcacagtctctgacggccctctagtgagctgacacgacgcccaccgttcggtggtcggtcgtaccccgaggacaaaccggcaaggactaccgngctgtaggagatgtcgtattagaaaacctaaaaaattntacgttcgtttacggtacgtaaccgtaaggaaaaggacgtacggacgggacccgaaccgggtcccggttggtacgtcctacgtactacgttacacggaacgaaccgtaaaaggaaaaccccggtccccggtaaccgggtacccttacccggtagtaaacgggtaactttaccgttccggtccgttaccgggtaccccttaccccggaacccgtttacggtaaccccggggtaaccttaaacggggtcccggttaaccccggtttaaggttaacccgtaaaccgtttaaccggttaccggggaacccgggggtacccggggggtacccccgggtaaagggggtttacgggggaacgggttaaaccgggtaaggggggttaaacggttaaccggttaaccgttaaacgttttacccggtttttaacgttaacccgttaaaccgtaaacccccggtaaacggtaaaccccgttaaaccggttaaaaacgggaaaccgtttaaaaccgtaaaccggtaaaccggtaaacggggtaaaacgggtttaaaccggttaacggggtaaacccggggggttaaaccggggggaaaccccggggttaaaccgtaaaccgggttaacccgggttaacccgggttaaacccgggtttaaacccccgggtttaaaaccgggttaccccggaaaccccggggttaaacccccgggtaaacccggggttacccccgttttacccccccggggtcccccccgggtttaaacccgggttttccccggttaaaacccggtttccccccgttttttaaccccccggtacccccccggttttcccccccgttccccttttcccccccggtttaacccccg

SEQ ID NO: 70312 - DNA, 1050 bp, Homo sapiens
  misc_feature: GYAE6OF01D9MNU.49.26.C04.1.454.CMB.1.raw
tcagagtcgagagacacgaccggtgctcgatttagtctagcgactttgggtttggggggtaaggaggaagactgacggtcccccaagagttcaggtgctgggcacggtgggcatgtgtgtagttttgtcacagtatttggctcaactctcttgtccaccttggtgttgtctgtagtcgttgggttttccttgttcgtacgtttaacgttttaaaacggttcgttcccgtaaggttcggttaggtaaagttcgtacgtaaggtttcgggttacggtaacgttccgggttaggggggtacggttccgggttacgggttaacggaacggtcccgggttaccgggggggttaccccgtaggtaaccggtaccgttccgttccgttacggtaccgtaccgtaacgtcccttaccggttacggtaacctttaccgttaacgtttaccgtttagtaacgttagttaacttacgttacgaccgtaggttacgtaaccgtacgtacggttaccgtacccgttaacgtaccgggtaccggggttaaccggggtacgggttacgggttacggggtacggttcgggttaccgtttacggtttaacgtttaaggtttacgggttacgggttacggtttaacgggttaacggttaccttaacccgtaaccgttaacgtttacgtacggtaaccttacgggttacccttacgggttaagggttaacccggggttaaccgggttacccgtttaaaccgttaccccgaaacccgtttacgtaccccgggttaacgttaaacggtaaccggtaaacccgttaaccggacgttaacccgtaaacccggtttaaaccccttcccgggtttaattaccccgttaacggtaaccgttaaaccggtaacgtaccggttaaaacgttccgttacccgggtaagtaaggggttaccggtaccggtaacccgtaaccccggttccgtttaaaccccgtttcgtaaaccgttacgtagttaaacccgttaacggtaaactttacccgggttaaccgtcccgtaacccttaaacccgg

SEQ ID NO: 70313 - DNA, 711 bp, Homo sapiens
  misc_feature: GYAE6OF01BGTIA.49.26.C04.1.454.CMB.1.raw
  modified_base (451)..(451): a, c, t, g, unknown or other
  misc_feature (451)..(451): n is a, c, g, or t
tcagagtcgagagacacgaccggtgctcgatttagtctagcgactttggggtttggggggctctggggaaaggagccccagccctgagattcccaggtgtttccattcggtgatcagcactgaacacagaactcaccatggagtttgggctgagtcgttgggttttccttgttgcttaattttaaaaggtgtctagtgtgaagtgctaggttggtggaagttcggtgggggggtagtcggttgggtagacggtccggtcgggggggtccctggagtaccttcctccgtggtcgcacgtcctcgtggtacttctaattcgtttagattgtattatcgctatcgactacgtggtactccggtacgacggtaccgggtaccgggggtaaggtcggtagggtacggtcggttcttcttacttagttaggttggtaggtggtgtactctacgtatntcgacagtcgtgtggtaggtaggtctacttcaacctatccgtaacgacggtaaacaacgtaacggcgaaaccgttaaccgtaaaccccttccgttaggtaacctcgaacgtaaacgtacgaaagtactacggtaccgtagaacggggagtaccggaaccgtccccgtaacgttccttacggtactaggttacgacgtaaaggtaaacgtcggtacgaaccgttaccgtaacctctttaagtacccgcgtacccggtcggg

SEQ ID NO: 70314 - DNA, 459 bp, Homo sapiens
  misc_feature: GYAE6OF01A5UT3.49.26.C04.1.454.CMB.1.raw
  modified_base (241)..(241): a, c, t, g, unknown or other
  misc_feature (241)..(241): n is a, c, g, or t
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
  modified_base (426)..(427): a, c, t, g, unknown or other
  misc_feature (426)..(427): n is a, c, g, or t
  modified_base (430)..(459): a, c, t, g, unknown or other
  misc_feature (430)..(459): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaacgccctccgggatccctgagagattctctggctccacctcagggaccatggccagttgactatcgaggccggggcccagggtggaggagtggaaggtnacttatattgttactcaccagaccacagtagaaaatcanagaaggtaatagttcggnggaggaccaagctggaccgtccgtaggtcaggcccaaggcctcgccccgtgtcactccgtcgttcccgcccttcctctccttcgtccgtactctggacggcggcgtaggacgtaagcganacgtagcnntgnnnnnnnnnnnnnnnnnnnnnnnnnnnnnn

SEQ ID NO: 70315 - DNA, 906 bp, Homo sapiens
  misc_feature: GYAE6OF01CCB4D.49.26.C04.1.454.CMB.1.raw
  modified_base (883)..(883): a, c, t, g, unknown or other
  misc_feature (883)..(883): n is a, c, g, or t
  modified_base (892)..(892): a, c, t, g, unknown or other
  misc_feature (892)..(892): n is a, c, g, or t
tcagagtcgagagacacgaccggtgctcgatttagtctagcgactttgggtttgggggctctgggaaaggagccccagccctgagattcccaggtgtttccattcggtgatcagcactagaacacagaactcaccatggtagtttgggactgagccgttgggttttccttgttgtcttaagttttaaagggtcgtccaggttgtgtaaggtgcgtaggttgggtaggtaagtcggtagggggtacgtcggttagggacggtacgggtcccgggttcgggggggtaccctggaacggtacctcgttccgtaggtcgaccacggtccttacgtaggtacttacgttacgttacgtttaggaactttagtaacgttttaacgtacggtaaccctagtaccgtaccgttaacggtaacggtttaacctaccccgggttaacgtaaccgggttacccggggtaaacccgggggttaaggggttcctaccgggggttaagggtttccgggtttaaccttacccggttttaaagttttaagggttttaaaaccggtggggtttaacggttacggggtttaacggttaaaccttacccggttaaaccgttagttaaccggttacggaaccgttaaacggtttccgttaccggttaacggttacgggtaaacggtttcgttaacctaaccgttaacctacgttacccgaacggtaaacgacgaaacctaacgacgtaacggtaacctaccgtccgtagtaactcgaagtaactaaatcggaaatttcgaactagtaggttacggacgacgtactaccgtactttacgaacgtcgaagttacgaaacggttaagtccccgaaggtcccttaaaccctcttaaacccggtttanacccggtancccgtaacccgggg

SEQ ID NO: 70316 - DNA, 866 bp, Homo sapiens
  misc_feature: GYAE6OF01E2G5Q.49.26.C04.1.454.CMB.1.raw
  modified_base (204)..(204): a, c, t, g, unknown or other
  misc_feature (204)..(204): n is a, c, g, or t
tcagagtcgagagacacgaccggtgctcgatttagtctagcgactttgggtttgggggctctgggaaaggacgccccagccctgagacttcccaggttgtttccattcggtgatcagcactgaacacagaactcacgatggtagttggctgagtgttggttttccttgttgtacttaagttttaaaggtgtcagttgtagagtntctaggttggtagagtcggtggggtagttcggtgggtacgcgtccgggttcgggggtcctaggtacgtaccttccgtaccgtgttcgaccgtacgtccgttacgtcggtacttcgtacttttaccgttggtaactacgttattacgtcaccgtagttcgaccgttacgtacgtccgttacccggtaccgtaacgggtccgggtaccggggggtaacggtttacggtacggggtacggtttacgggttccgtttacgtttaccgttttaaaggtttacgggtttagggtaatttacggggtcgttaaacgtacccgtaacgtttaaccgtagtcgaaccgtaggttaccgtacggttaaggtacgggtacgtcgtactacgacgttactaccgtacgacgaagaaccgacgtaacgaccgtaaaccttcgtacccgttcgtaacttcgtaaacgaacgtaacgtacgacttacggtaacgtaccggtaaggtaaccgggtccgtaaacccggaccccgttacccgttaacccgttacgtaaacccttttaaggaaccggtaaccgtaaaaccgggtaaaggttccgtttaaacccggccccttaaacggtaaccccgtttaattttaacccggtcccttaaacccggtcccggggtaacccgg

SEQ ID NO: 70317 - DNA, 657 bp, Homo sapiens
  misc_feature: GYAE6OF01A69BZ.49.26.C04.1.454.CMB.1.raw
  modified_base (403)..(403): a, c, t, g, unknown or other
  misc_feature (403)..(403): n is a, c, g, or t
tcagagtcgagagacacgaccggtgctcgatttagtctagcgactttgggtttgggggaagaggaagactgacggtccccccaggagttcaggtgctgggcacggtgggcatgtgtgagttttgtcacaagatttgggctcaactctcttgtccaccttggtgttgctgagctgggttttcctgttgctatttaaaggtgtccagtgtgaagtgcagttggtggaatcgtgggggagtcgtggtagagccgtggggggtccctgagactctcctgtgcagcctcgtggattcatctttgatcgattatgccatgcactggactccgtcaagccggtacggggaaggtcgtggaggtcggtctcgttcttaattaggttggtagttggtgtactcacgtactancgactagtacttcgtggtacggaaacgggttcgtacttcccaaacgtcttccaaccgagaaccgtaacaacgtagaacgtaaacgtaacccttccgtatcctaacgtaccgaacgtaaagtacgaaaccgttgtaccgtaacgaggggttagaccggaacgggaaaccctcccgttaaccttccttaaccgacgtttacggaactaaaccggaaaagttaccggtttaccggaaccgtaaccccgtaaaccccg

SEQ ID NO: 70318 - DNA, 744 bp, Homo sapiens
  misc_feature: GYAE6OF01ANW0W.49.26.C04.1.454.CMB.1.raw
  modified_base (125)..(125): a, c, t, g, unknown or other
  misc_feature (125)..(125): n is a, c, g, or t
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
  modified_base (512)..(512): a, c, t, g, unknown or other
  misc_feature (512)..(512): n is a, c, g, or t
  modified_base (571)..(571): a, c, t, g, unknown or other
  misc_feature (571)..(571): n is a, c, g, or t
  modified_base (648)..(648): a, c, t, g, unknown or other
  misc_feature (648)..(648): n is a, c, g, or t
  modified_base (736)..(736): a, c, t, g, unknown or other
  misc_feature (736)..(736): n is a, c, g, or t
tcagagtcgagagacacgaccggtgctcgatttagtctagcgactttggggtttgggggctctgggaaaggagccccagccctgagattcccaggtgttccattcggtgatcagcactgaacacngaaaaactcaccatggtagttgggctgagtcgttgggttttccttggttacgtcgttaagtttaaaaggtcgtacctaggtggtaggtaggtgacgtagcgttgggtggtacgtcggtgggggcgtcgtacggtacgcggtccgggtacggggtccgtaggacgtacctccgtccgttggtcgcgacctcctacggtcggttacttcccgtaacttgttccgttagttcgacggtaggtccggtcgtaggccccncggacggtaccgtagggacggggtacggcgtagggtgggttaccgnttaccgaagttaggtacggtccggttagtacgttaccaactacgtactaacggcacgtaaacgtcctacggggtagaaccggtccnctaaacgccgtaactcgaccgaatacgtacaactaccgaagtacgtgttagttccgtanacgtaacgtactacggctacggacgttgccgaagggtacccacggtaaccgacggtaccgttaattacttggtacgnggttaccgaggttttaaccggcgtacgttcggagttaacccgttggtacgtacgacgggtttacggacgggacgttaaacggtcccgngttacccg

SEQ ID NO: 70319 - DNA, 859 bp, Homo sapiens
  misc_feature: GYAE6OF01B1Y7S.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggtagtttgggctgagtcgttgggtttttccttgttgtcttaaagtttttaaaaggtgtacctaggtgtagaagtgctaggttgggtaggaagtcggtgggggagttcggtgggtaggacggtccggttcggggggtccctggacgtaccttccgtcctggtcgacgacgtcccgttcgtaggtacttctatttcgtttagattagtatttacgtcgacctagttcgactacgtcgactccgacgaacggtcggtacggggtacggtcgtaggtaggttcgtctctttacttaagttaggttggtagttggttacgtactacctaaccgttagtagtcgtacgaacgttcgtacggttaggtacgggttaacggtccgttaaccgtttacccgaaccgttaaacttcccggtaaccgaaaacgggtaaacccgaaaacgtaaaccgtacggaaaccccgggttaaaacccgttaccccgtttaaccgttagtaaacccggtttcttaaaccggaaaccgtttaaagtacggtaaaccgtttaccgtaacccgggttaaggaaacgggttacgggtaaccgtaaccccgggttaccctacccggtttaccccttagttaccccgtaagttaaccgggtacgttaaaaagtaacggttaacccgggttacccaccgtaaaccccttatttacccgttacgtttaaccgcccgtccggtacccggg

SEQ ID NO: 70320 - DNA, 532 bp, Homo sapiens
  misc_feature: GYAE6OF01B6QC7.49.26.C04.1.454.CMB.1.raw
  modified_base (504)..(532): a, c, t, g, unknown or other
  misc_feature (504)..(532): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacaagaaaacgacccctccgggatcccctgagagatttcctctggcctccacctcgagggacccagtcggcccacggttcgactacttcgacggccgggggcccgagggtgggaggataggaaaggtcgtaactacgttagttcgttaacctccaccgaacgaccaaccgtaagtaagaaaatcaacgagaaggtaatagttcgggacgggagggtaccaaggcctacggaccgtaccgtaggtacacgcccggaagccctccggcccctcggtcaccgttctaccgtccccctaccctcctccgtcctccgttccgcccgttacgcggtaccggcggtaccgtcgggacgaccggtcacgtagtacgnnnnnnnnnnnnnnnnnnnnnnnnnnnnn

SEQ ID NO: 70321 - DNA, 842 bp, Homo sapiens
  misc_feature: GYAE6OF01D5NVA.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccagtggtagtttgggctgagcgttgggtttttccttgttgtacttaagttttaaaaggtgtacctagttgtagaagtgcgtaggttggtaggaagttcggtaggggtagtcggtaggtaggacggtccggttcggggggtccctagacgtacctcctccgtgtgccacgtccgttcgtagtactttacgtacttttcgtttagtattaggttaactttagtcgtcctaagtccgaccgtacgttaggtaccgttaccggtaacggtaaccggtccggggttaccgggggtaaggtccggtagggttacgggttcggttccttcgtttactttaaaggtttaggttagggtagttagggtcgttaactacctaaccgttatacggtcgtacacgtaccttggtacggtaaggtacgggtacttaccgtacacctacttcgaccgaaggaacaacgaacgacgaaccgtaacgtaacccgttaccgttataacgtaacctacgtaaaactaacgtaacgtaaaccgtcttaccggtaacgtaagggtaccgggtacgaacccgtaccccgtttaaccggtccctttaacggtacgttaaccggtacggtaaaaccgttaaacggttaaaaagtccgggtttaaccgaaccgtaaaccctttaaccccgttaacttttaaccgtacccggtaaccgtcccgggtaacccggg

SEQ ID NO: 70322 - DNA, 838 bp, Homo sapiens
  misc_feature: GYAE6OF01E4LIE.49.26.C04.1.454.CMB.1.raw
  modified_base (172)..(172): a, c, t, g, unknown or other
  misc_feature (172)..(172): n is a, c, g, or t
  modified_base (256)..(256): a, c, t, g, unknown or other
  misc_feature (256)..(256): n is a, c, g, or t
tcagagtcgagagacacgaccggtgctcgatttagtctagcgactttgggtttgggtgggctcaggaggcagagctctgggaatctccaccatggcctggacccctctcctgcctccccctcctcactttctgcactagtctctgacgcctcctatgagcgtgaccacgacncccaccgtcggtgtccggtcgtcccgagaccaacgcaggactaccgtgctcgtaggagtatgctattacgaaacctaaaaagtntcgtacgttggtacgtaaccgagtaagacgtcgacggccgacggccccggttagttcgtctctacgtctagtagaaccgtaaccgaacggtaaacccgtacccgtaccggtacctccgtacggacgtacgttactccgttcgtcgacccctccgtaaccgtacggaccggtaccgacggtccgtacccgtaacggttacgcgttaagtaccgggaccgggtcccggggacgtagggggaacggtacgggtacgaacgggtaacggttaacgtacgttaacgtttacgtttccgtttaaccgccgtaaaccgaccgtaacgtaaaccgtacgtaaacgtaaccgtacgaagaacgggtaacgtaacggttacgggttaaccgggaccggggtaacggaaacccgggtacgtacccggtaccggttaacccggtccggttaaccggttaccgaacccccggtaccggtaaacccggttccccgttaaacccccgggtccccctttaccgggtcccctttaacccggttcccccggttaccccgttcccccgtttacccccggtttcctaaccccggtttccccg

SEQ ID NO: 70323 - DNA, 602 bp, Homo sapiens
  misc_feature: GYAE6OF01EQUC2.49.26.C04.1.454.CMB.1.raw
  modified_base (217)..(217): a, c, t, g, unknown or other
  misc_feature (217)..(217): n is a, c, g, or t
  modified_base (558)..(559): a, c, t, g, unknown or other
  misc_feature (558)..(559): n is a, c, g, or t
  modified_base (562)..(602): a, c, t, g, unknown or other
  misc_feature (562)..(602): n is a, c, g, or t
tcagagtcgagagacacgaccggtgctcgatttagtctagcgactttgggtttgggggagatgcattgccaaaaaaaatatgcttgttggtaccagaagaagtcaggccaggccccggtgttgctcatctatgacacagaaaaccgccctcgggatccctggagagattctcgtcgtcctccacctgacgggacccagtcggcctagttgaccttancgaggccggggccagggtggaaggctaggaaggtgtacttagttactttacgttaccaccaccgaagtaccaacggtacgtagaaaacttcaacgaaggtaaggtaagttaacggttaccgggacgggtaacggaacccgaagtcgtaccggaccgttccggtacggtaccgaccgaccgaacgggtcccgtacccgtcccccggtcggtaccctccgtttcccgttccccggtttaccccaaccccctttccctaccttcccgtacgtacccgttacgtaccgttacgggaccgggtccggtcgtaccggggacgacggacccggatacgtaagcagcanncannnnnnnnnnnnnnnnnnnnnnnnnnnnnnnnnnnnnnnnn

SEQ ID NO: 70324 - DNA, 711 bp, Homo sapiens
  misc_feature: GYAE6OF01AV43S.49.26.C04.1.454.CMB.1.raw
  modified_base (217)..(217): a, c, t, g, unknown or other
  misc_feature (217)..(217): n is a, c, g, or t
  modified_base (593)..(593): a, c, t, g, unknown or other
  misc_feature (593)..(593): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (620)..(620): a, c, t, g, unknown or other
  misc_feature (620)..(620): n is a, c, g, or t
  modified_base (626)..(626): a, c, t, g, unknown or other
  misc_feature (626)..(626): n is a, c, g, or t
  modified_base (641)..(642): a, c, t, g, unknown or other
  misc_feature (641)..(642): n is a, c, g, or t
  modified_base (649)..(649): a, c, t, g, unknown or other
  misc_feature (649)..(649): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (665)..(666): a, c, t, g, unknown or other
  misc_feature (665)..(666): n is a, c, g, or t
  modified_base (683)..(683): a, c, t, g, unknown or other
  misc_feature (683)..(683): n is a, c, g, or t
  modified_base (690)..(690): a, c, t, g, unknown or other
  misc_feature (690)..(690): n is a, c, g, or t
  modified_base (701)..(701): a, c, t, g, unknown or other
  misc_feature (701)..(701): n is a, c, g, or t
tcagagtcgagagacacgaccggtgctcgatttagtctagcgactttgggtttggggagatgcattgccaaaaaaaatatgcttgttggtaccagaagaaagtcaggccaggccccggtgttgctcatctactgacgacaagaaaaccgcccctccgggatcccctgacgagattctcgtcggcctcccgacctcgaggaccagtcggcctaggttnacgtagtcgacggtccgggcccgtagggtcggaggtacgtacggaacggttcgtaacttaaccttaagtttcggttaacctcccgaccgaaaccgtaaccgaacccgttaggtaaacgaaaaactccgaaaccgtaggaaacggtaacttacgttaccgggaccgggtaacggaaacccgaacggtaccgtaccggtaacccgttcccgtaggttaccgaaccggtacccgaacggtccctcccgcccccgtcggtcccgtacgttccgtcccgttacccctcccgttacccttccgtccttacctcccgttaacgttccgtaggtaccggtaccggtacgtccggaaccgaacgggtccgacgtaacgtaacgcncgtaacgcgttanacgngcgcgcgtgngtcgtntgtcgtcgtacgtcnnctcgcgngtgacgncgangancnncgagtacgtcgtagtcntcgtacncgtacgcgagngtcgtcgacg

SEQ ID NO: 70325 - DNA, 713 bp, Homo sapiens
  misc_feature: GYAE6OF01AJAUA.49.26.C04.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagagtcgagagacacgaccggtgctcgatttagtctagcgactttgggtttggggggaagaggaagattgacggtccccccaggagttcaggtgctgggcacggtgggcatgtgtgagtttttgtcacaagatttgggctcaactctcttgtccacctttggtgttgctgagctgggttttccttgttgctattttaaaaggtgtccagtgtgaagtgcagttggtggaatgtggggagtcgtggtagagccgtggggggtccctgagactctccgtgtgcngcctcgtggtnttcattctttgatgtattancgcctatcgcacgtggactccgtacaacggtcggtaccgggggaagggtcgtgggtaggtcgggttccttacttactttaagtttaaggttgggtacgttggttacggtaacttaccgtaaccgttacttagtcgacgtacgttaccgttgtaggttaacgggtaacgggttaccgttaccttaccccaacccgtattcccgtaaccgaacggtaacgtaaaccaaacgacgaacctaaaccggttaaccctcccgtttaagtctacgtacgaaacgtaaatacggaaccttaacggtctaacggaggtacggtaccggaaccgcccgttaacccgtcctttaacggtacctagtaggtaactaaacgaaacgttcggtaacgcctacccttaaaccg

SEQ ID NO: 70326 - DNA, 791 bp, Homo sapiens
  misc_feature: GYAE6OF01EMYYB.49.26.C04.1.454.CMB.1.raw
  modified_base (226)..(226): a, c, t, g, unknown or other
  misc_feature (226)..(226): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgacggcctcctatgagctgacacacgcccacccgtcggtgtcggtcgtcccgaggacgaacggcaggactacctgctcgtgganagtgactattacgaaaacctaaaaaaattgtgtcgtttaggttacggtaaaccgaaggaacgaagtccgacgggcccgaccgggtccccgggtgttcgcctacgacttctaagtacgaaccggaacgaaaacggaaacccgtacccggtaccgggtacctacccggtagaacgtaagtcttccgtccgtacggtccctacccgaccgtcgaacgggacctagtccgacctacggttcaactacgtaccgacgggacccggggccgtaagggtcggagtaagtagggtaaccggtataccggtttaacgtttgttaaccgtaacgaccaaccggtacgtaacccaaaccggtaagtaaacgaactccgaagaacgtaaggtaactttacggggaccgggaacggaaggtaccgtaacgtaccgggtaccgtaaccggtccggtaaccggtacgaaccccggaccggtaccggtacccgtcccccgggacccccttaccgggtaccctaacccgtttcccgtaacccccgtttacccccctacccgtttcccgtcccttacccccgg

SEQ ID NO: 70327 - DNA, 880 bp, Homo sapiens
  misc_feature: GYAE6OF01DJ17Q.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgtagttttgtcacaagtattgggctcaactctcttcgtcctaccttggtgttgctgagtcgttgggttttccttgttgtacttaaagttttaaaggtcgtacctaggtgtagaagtgtctaggttgggtaggtaagttcgggtagggggtacggttcggttagggtacggtacggtcccggggttacggggggtcccgtaggaccgttaccttcctcgtgtcgtacgtcgtcccgtgtagtacttccgtagtttcttaggattacgtatttacgtccgtacctagtacgtaccgttacggtacggttacctccggtaacggacggtaccggggtaacgggggtaggttacggtcgggtacggttccggtctttacgttttaacgtttaaaggtttacgggttaggggttaggtttacgggtttacggttaaccttaacccggttaaccttaaacgttaggttaccgaacggtaccgtttaccggtaggttacgggtacgggttaaacgggttcgttaaccgtaacccgtccttaacgtaccgtaccgaacggactaaacggactaccgtaactaaccgttacctacgttacgttactacgtaacaagttaactacgtaccgtaacggtacctaacggtacggtaacggtaccggtaaccgtaccccgttaaccgttacccgttaccgttaacgtacgttaacggtaacgtaaaccggttaaacggttacgtttaaaccggaaccgtaacccgtttaaacccgg

SEQ ID NO: 70328 - DNA, 394 bp, Homo sapiens
  misc_feature: GYAE6OF02JIV71.49.26.C04.1.454.CMB.1.raw
  modified_base (390)..(394): a, c, t, g, unknown or other
  misc_feature (390)..(394): n is a, c, g, or t
tcagagtcgagagacacgaccggtgctcgatttagtctagcgactttgggtttgggagatgcattgccaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccgcctcctctctctcgactctgagcggctggcaaggcgcatagnnnnn

SEQ ID NO: 70329 - DNA, 394 bp, Homo sapiens
  misc_feature: GYAE6OF02F1EFN.49.26.C04.1.454.CMB.1.raw
  modified_base (391)..(394): a, c, t, g, unknown or other
  misc_feature (391)..(394): n is a, c, g, or t
tcagagtcgagagacacgaccggtgctcgatttagtctagcgactttgggtttgggagatgcattgccaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccgcctcctctctctcgactctgagcgggctggcaaggcgcatagnnnn

SEQ ID NO: 70330 - DNA, 397 bp, Homo sapiens
  misc_feature: GYAE6OF02JHQII.49.26.C04.1.454.CMB.1.raw
  modified_base (386)..(386): a, c, t, g, unknown or other
  misc_feature (386)..(386): n is a, c, g, or t
  modified_base (392)..(397): a, c, t, g, unknown or other
  misc_feature (392)..(397): n is a, c, g, or t
tcagagtcgagagacacgaccggtgctcgatttagtctagcgactttgggtttggggagatgcattgccaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtctaggtcagcccaaggctgcccctcggtcactctgttcccaccctcctctctctcgactctgagcgggctggcaaggcncatagnnnnnn

SEQ ID NO: 70331 - DNA, 418 bp, Homo sapiens
  misc_feature: GYAE6OF02FPT1E.49.26.C04.1.454.CMB.1.raw
  modified_base (397)..(418): a, c, t, g, unknown or other
  misc_feature (397)..(418): n is a, c, g, or t
tcagagtcgagagacacgaccggtgctcgatttagtctagcgacttgggttgggagatgcattgccaaaatatgcttgttggtaccagaagaagtcaggccaggccccggtgttgctcatctatgacgacaggaaaacgaccctccggggatcccgttgagtagattcctctgggctcccaccttcaggggaccatggccacgttgactatcgagcggggcccaggtgggagatgaaggtgactactattgttactcaccagacaccagtgaaaatcactagaggaatattcggcggaggacagctggaccgtcctaggtcagcccaaggctgcccctggtcactcgtgttcccacctcctctctctcgactctgagcggctggcaaggcgcatagnnnnnnnnnnnnnnnnnnnnnn

SEQ ID NO: 70332 - DNA, 126 bp, Homo sapiens
  misc_feature: GYAE6OF02F4LCK.49.26.C04.1.454.CMB.1.raw
  modified_base (126)..(126): a, c, t, g, unknown or other
  misc_feature (126)..(126): n is a, c, g, or t
tcagagtcgagagacacgaccggtgctcgatttagtctagcgactttgggtttggggctgcccctcggtcactctgttcccaccctcctctctctcgactctgagcgggctggcaaggcgcatagn

SEQ ID NO: 70333 - DNA, 394 bp, Homo sapiens
  misc_feature: GYAE6OF02II6SN.49.26.C04.1.454.CMB.1.raw
  modified_base (391)..(394): a, c, t, g, unknown or other
  misc_feature (391)..(394): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggaggaccaagctgaccgtcctaggtcagcccaaggctgcccctcggtcactctgttcccacctcctctctctcgactctgagcggctggcaaggcgcatagnnnn

SEQ ID NO: 70334 - DNA, 417 bp, Homo sapiens
  misc_feature: GYAE6OF02IGUNI.49.26.C04.1.454.CMB.1.raw
  modified_base (393)..(393): a, c, t, g, unknown or other
  misc_feature (393)..(393): n is a, c, g, or t
  modified_base (400)..(417): a, c, t, g, unknown or other
  misc_feature (400)..(417): n is a, c, g, or t
tcagagtcgagagacacgaccggtgctcgatttagtctagcgactttgggtttggggagatgcgattgccaaaaaaatatgcttgttggtaccagaagaagtcaggccaggccccggtgttgctccatctatgaccgacagaaaacgccctccgggatccctgagagattctctggctccacctcagggaccatggccacgttgactatcagcgggcccaggtggaggatgaaggtgactactattgttactcaccagacaccagtgaaaatcaacagaggaatattcggcggagggaccaagctgaccgtctaggtcagcccaaggcctcgccccctcggtcactctcgttcccaccctcctctctctcgactctgagcggctggcaaggcncagtagnnnnnnnnnnnnnnnnnn

SEQ ID NO: 70335 - DNA, 399 bp, Homo sapiens
  misc_feature: GYAE6OF02JE3YL.49.26.C04.1.454.CMB.1.raw
  modified_base (393)..(399): a, c, t, g, unknown or other
  misc_feature (393)..(399): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccaccctctctctctcgactctgagcggctggcaaggcgcatagnnnnnnn

SEQ ID NO: 70336 - DNA, 904 bp, Homo sapiens
  misc_feature: GYAE6OF02JHHBA.49.26.C04.1.454.CMB.1.raw
  modified_base (735)..(735): a, c, t, g, unknown or other
  misc_feature (735)..(735): n is a, c, g, or t
tcagagtcgagagacacgaccggtgctcgatttagtctagcgactttgggtttgggggaggattcgacagttgtccgaaaaaatagtgcttgttaggtaccaggaagtaagtcaggcccaggccccggtgttgtctctagttctatcgacggacacgtaaaacggtacccgttccggggacttccccggtagtaaggtacggtattctcgtgggcctcctaccctcgacgggtacccagtcggtccgacggtttcgtaccgttaggtccggaacggaccgggggcccccaacgggttcgggtacgggaacttgggaaacgggttacggtaacccttaaacccgttaaccttttagggtttaaccttaccgttaacccttacggaaccccaaccctaaggttaacgaaaaaacttccgtaaccgaccggtaagggtaaaccttaacgttaccgggaacggggtaaacggggtaacccgaaaaggtccgttaccggtaaccccggttaaccccttaacgggttaccgtaaacggttaccccccgtaaagggggtcccgtttaccggtacccccccccggttacgggttacccttaacccgggtttccccttaccggtttaccccctaacccccgttcccgttaccggtaccgttcccgttaccgggtacctttccggtacgtaacggttcccggggacttacgggaccaaacgggccgtaccgaagtaacgcgtctntacagtcagagtactggcgcgtagtacgtacgtctcgtactactatacgtattacgtcgttacgttactacgttacgtacggtacggtacggtacgtagtacgtagtacgtaacgaacgtacggtcggtacgtacgtaccgtacggtaccgtcgtcgttcgtacgttcc

SEQ ID NO: 70337 - DNA, 535 bp, Homo sapiens
  misc_feature: GYAE6OF02JCEMZ.49.26.C04.1.454.CMB.1.raw
  modified_base (240)..(240): a, c, t, g, unknown or other
  misc_feature (240)..(240): n is a, c, g, or t
  modified_base (469)..(469): a, c, t, g, unknown or other
  misc_feature (469)..(469): n is a, c, g, or t
  modified_base (496)..(496): a, c, t, g, unknown or other
  misc_feature (496)..(496): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgccctccgggatccctgagagattctctggcctccacctcagggaccagtcggccacgttgactatcgaggccggggcccagggtgggaggagtggaaggtgactactattgttactcaccagacacagtagaaatcacagagaatagtggcggaggacaagcngaccgtctaggtcacgcccgaaggccncgcccccgtcggtcacttctcgtacccaccctcctctcc

SEQ ID NO: 70338 - DNA, 405 bp, Homo sapiens
  misc_feature: GYAE6OF02F9TID.49.26.C04.1.454.CMB.1.raw
  modified_base (398)..(405): a, c, t, g, unknown or other
  misc_feature (398)..(405): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgtaactcaccagacaccagtgaaaatcaacagaaggaatattcggcggagggaccaagctgaccgtcctaggtcagcccaaggctgccccctcggtcactctgtcccgcctcctctctctcgactctgacgcgggctggcaacggcgaccatgnnnnnnnn

SEQ ID NO: 70339 - DNA, 396 bp, Homo sapiens
  misc_feature: GYAE6OF02ITP4U.49.26.C04.1.454.CMB.1.raw
  modified_base (392)..(396): a, c, t, g, unknown or other
  misc_feature (392)..(396): n is a, c, g, or t
tcagagtcgagagacacgaccggtgctcgatttagtctagcgactttgggtttggggagatgcattgccaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtccaggtcagcccaaggctgccccctcggtcactctgttcccgcctcctctctctcgactctgagcgggctggcaaggcgcatagnnnnn

SEQ ID NO: 70340 - DNA, 523 bp, Homo sapiens
  misc_feature: GYAE6OF02HSAUY.49.26.C04.1.454.CMB.1.raw
  modified_base (432)..(432): a, c, t, g, unknown or other
  misc_feature (432)..(432): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcactactatgcagactctgtgaagggtcgattcaccatctccagagacaacagcagaaactccctgtattcngcaaatgaacagtctcagaggtgaggacaccgccttctactactgtgacaaaagattacggtgaccactaccttattttcgacctactcgg

SEQ ID NO: 70341 - DNA, 395 bp, Homo sapiens
  misc_feature: GYAE6OF02I1R3E.49.26.C04.1.454.CMB.1.raw
  modified_base (392)..(395): a, c, t, g, unknown or other
  misc_feature (392)..(395): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgcccctcggtcactctgttcccacctcctctctctcgactctgagcggctggcaaggcgcatagnnnn

SEQ ID NO: 70342 - DNA, 504 bp, Homo sapiens
  misc_feature: GYAE6OF02JCN71.49.26.C04.1.454.CMB.1.raw
  modified_base (236)..(236): a, c, t, g, unknown or other
  misc_feature (236)..(236): n is a, c, g, or t
  modified_base (415)..(415): a, c, t, g, unknown or other
  misc_feature (415)..(415): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaanagacaccattgacttatgtcttcgaactgcgacaagtcacgtctgggtcagcccaagcccaacccgactcgtcactctcgttcccgccc

SEQ ID NO: 70343 - DNA, 534 bp, Homo sapiens
  misc_feature: GYAE6OF02IRDM5.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgccctcgggatccctgagagattctctggctccacctcagggaccatcggccacgttgactatcagcgggcccagggtgaggagtgaaggtgactatattgttactcaccagacaccagtagaaaatcaacagaggaatagttacgggagacgggacaagcgtgaccgtctaggcacgcccgaaggcctcggcccctcggtcacctctcgttcccacccttcctcctcc

SEQ ID NO: 70344 - DNA, 396 bp, Homo sapiens
  misc_feature: GYAE6OF02HH0GF.49.26.C04.1.454.CMB.1.raw
  modified_base (393)..(396): a, c, t, g, unknown or other
  misc_feature (393)..(396): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgtcccgcctcctctctctcgactctgagcgggctggcaaggcgcatagnnnn

SEQ ID NO: 70345 - DNA, 400 bp, Homo sapiens
  misc_feature: GYAE6OF02GNA83.49.26.C04.1.454.CMB.1.raw
  modified_base (397)..(400): a, c, t, g, unknown or other
  misc_feature (397)..(400): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatatcggcggagggaccaagctgaccgtcctaggtcagcccaaggctcgccccctcggtcactctcgttccccacctcctctctctcgactctgagcgggctggcaaggcgcatagnnnn

SEQ ID NO: 70346 - DNA, 600 bp, Homo sapiens
  misc_feature: GYAE6OF02I5PRI.49.26.C04.1.454.CMB.1.raw
  modified_base (521)..(521): a, c, t, g, unknown or other
  misc_feature (521)..(521): n is a, c, g, or t
tcagagtcgagagacacgaccggtgctcgatttagtctagcgactttgggtttggggggaagaggaagactgaccggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtggggggtccctggagactctcctgtgcagcctctggattcattctttgatgattatgccatgctactggactccgtcaagcgtccggggaaggtctggagtgggtctctcttattagtggatggtgtatcactactgtgcagtactctggtaggaagggtcgtattcgacctatcctaccagaacgaacaacgacgcaagaaacctccctagtactctagactaaagtcgaaactcgtctacgaaggtaggtagaggtaacccnccggttacccttacgtaaccttaccgtggtacgaacgtaaaaacggttcgtttaaccgggtacctaacccgtaaacccg

SEQ ID NO: 70347 - DNA, 1195 bp, Homo sapiens
  misc_feature: GYAE6OF02ISL8Q.49.26.C04.1.454.CMB.1.raw
tcagagtcgagagacacgaccggtgctcgatttagtctagcgactttgggtttgggggaagaggaagactgacggtcccccaggagttcaggtgactgggcacggtgggcatggttcttggaacggttttttttagggtttcccgtaaccctaaaaacggggaaaacttttttttttttacgggggggggggggtacccccggtttttttaccccccgtaaaaaaaaaaacccccccgtttttttaccccccccgttttttttacccccccccgttttttttttttttacggggggggtttttttttacccccccccccccggtaaaaaaaccccccccccccccgtttttttttttttacggggggggggggtttttttaccgggggggtttttttttttttaaggggggggtacccccccccgtttttttttaccggggggggtaaaaaaaaggggggggttaccccccccgtttttttacccgggggggggggggggggggtttttttttttttttttttttttttaaccccccccccccccccctttttttttttttttacccggggggggtttttttttttttttaacggggggggggtttccccccccggttttttttaaaaaaaccgttttttttttttttttttttttttttaaaaaaaaaaaaaaaaaaaaaaaaaaccggggggggggggggttttttttacggggggggttttttttttacccccccccccccccggggtttaaaaaaacggggggggttttttttaccggggggggttttttttaacgggggggtttaaaaaaaaaaaccgggggggttttttttaggggggggtacccccccggttaaaaaagggggggtttttttttttacgggggggggggtttttttacgggggggggggtaaaaaaaaaaacggttttttaaccccccgggttttttaccgggggggggggggggggggggttaaaaagggggggttttttaccccccccggggggttttttacgggggggggggttttttaaaaacggggggtaaaacgggggggttaaccccccccccgggtttttttacgggggggggggggggggggggggggggttttttacccccccccccccccccctttttttaggggggggtaaaaaccggggggttaaaaaaccccccgggtttttta

SEQ ID NO: 70348 - DNA, 528 bp, Homo sapiens
  misc_feature: GYAE6OF02FVN1S.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctccgggatccctgagagattctctggctccacctcagggaccatggccacgttgactatcagcgggcccagggtgaggatgaaggtgactactattgttactcaccagacacagtagaaaatcacagagaatagttcggacggaggaccaagctgaccgtcctaggtcagcccgaaggcctgccccctcggtcactctcgttcccaccctcctctcc

SEQ ID NO: 70349 - DNA, 550 bp, Homo sapiens
  misc_feature: GYAE6OF02IFIKO.49.26.C04.1.454.CMB.1.raw
  modified_base (182)..(182): a, c, t, g, unknown or other
  misc_feature (182)..(182): n is a, c, g, or t
  modified_base (271)..(271): a, c, t, g, unknown or other
  misc_feature (271)..(271): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
  modified_base (449)..(449): a, c, t, g, unknown or other
  misc_feature (449)..(449): n is a, c, g, or t
  modified_base (515)..(515): a, c, t, g, unknown or other
  misc_feature (515)..(515): n is a, c, g, or t
tcagagtcgagagacacgaccggtgctcgatttagtctagcgactttgggtttgggggcgtctgggaaaggagccccagccctgagattcccaggtgtttccattcggtgatcagcactgaacacagaactcaccatggagtttgggctgagctgggtttccttgttgctattttaaaaggngtccagtgtgaagtgcagttggtggaatcgtgggggagtcgtgggtagagcctgggggggtccctggagactctcctgtgcagcctcgnggattcatctttgatgattatgccatgcactggatccgtcaagctccggggaaggtctgggagtgggtctctnttattaatgggatggtcgtancactactatgcagactcgtgtgaagggtcatcacatctccagagacaacgagcaagaaacttccctagtaatcctagacaaatnaacgtatctacgagaggtagaggacaccgccttactctactgtagacaaaagtacgttaacggtanaacccgaacaccttagttttacgaccaccgtacgg

SEQ ID NO: 70350 - DNA, 524 bp, Homo sapiens
  misc_feature: GYAE6OF02JZF0K.49.26.C04.1.454.CMB.1.raw
  modified_base (241)..(241): a, c, t, g, unknown or other
  misc_feature (241)..(241): n is a, c, g, or t
  modified_base (445)..(445): a, c, t, g, unknown or other
  misc_feature (445)..(445): n is a, c, g, or t
  modified_base (520)..(520): a, c, t, g, unknown or other
  misc_feature (520)..(520): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctccgggatccctgagagattctctggctccacctcagggaccatcggccacgttgactatcaggccggggcccagggtcggaggagtgaaggtgaactactagttgttactcaccagacaccagtagaaatcanagagatatcggagaggacaagctgaccgtcagtcagccgaaggctcgcccctagcactcgtcgttcccgcctccnctcc

SEQ ID NO: 70351 - DNA, 405 bp, Homo sapiens
  misc_feature: GYAE6OF02F2HKH.49.26.C04.1.454.CMB.1.raw
  modified_base (394)..(405): a, c, t, g, unknown or other
  misc_feature (394)..(405): n is a, c, g, or t
tcagagtcgagagacacgaccggtgctcgatttagtctagcgactttgggtttggggaggatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcggctggcaaggcgcatagnnnnnnnnnnnn

SEQ ID NO: 70352 - DNA, 398 bp, Homo sapiens
  misc_feature: GYAE6OF02GO5J1.49.26.C04.1.454.CMB.1.raw
  modified_base (394)..(398): a, c, t, g, unknown or other
  misc_feature (394)..(398): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcgggctggcaaggcgcatagnnnnn

SEQ ID NO: 70353 - DNA, 395 bp, Homo sapiens
  misc_feature: GYAE6OF02JEUG0.49.26.C04.1.454.CMB.1.raw
  modified_base (391)..(395): a, c, t, g, unknown or other
  misc_feature (391)..(395): n is a, c, g, or t
tcagagtcgagagacacgaccggtgctcgatttagtctagcgactttgggtttggggagatgcattgccaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcggctggcaaggcgcatagnnnnn

SEQ ID NO: 70354 - DNA, 427 bp, Homo sapiens
  misc_feature: GYAE6OF02F0FAY.49.26.C04.1.454.CMB.1.raw
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
  modified_base (391)..(391): a, c, t, g, unknown or other
  misc_feature (391)..(391): n is a, c, g, or t
  modified_base (398)..(427): a, c, t, g, unknown or other
  misc_feature (398)..(427): n is a, c, g, or t
tcagagtcgagagacacgaccggtgctcgatttagtctagcgactttgggtttgggggagatgcattgccaaaaaatatgcttgttggtaccagaagaagtcaggccaggccccggtgttgctcatctatgacgacagaaaacgaccctccggggatccctgagagattctctggctccacctcagggaccatggccacgttgactatcagcggggcccaggtggaggatgaaggtgactactatgttacncaccagacaccagtgaaaatcaacagaggaatattcggcggagggaccaagctgaccgtcctaggtcagcccaaggctgccccctcggtcactctgttcccaccgtcctcnctctcgactctgagcggctggcaaggccncatagcnnnnnnnnnnnnnnnnnnnnnnnnnnnnnn

SEQ ID NO: 70355 - DNA, 605 bp, Homo sapiens
  misc_feature: GYAE6OF02GUP2A.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacaagaaaacgacccgtccgggactccctgagagattctctggcctccacctcacgggaccagtcggcctacgttgactatcgacggccggggcccagggtcggaggacgtaggaaggtgacttacttagttgttactcaccagacaccagtagaaaatcaacaagaggaaatagttcgggacgggaacgggaaccaaggctacggaacccgtccgtaaggtccgacggacccgaaggccgtaccggccccccgttacggtccctaccgttccgttccggtttcccccgccccgttccctccttcccg

SEQ ID NO: 70356 - DNA, 527 bp, Homo sapiens
  misc_feature: GYAE6OF02F3POI.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctcgggatcccctgagagattctctggcctccacctcagggaccatggccacgttgactatcaggccggggcccagggtggaggatggaaggtgactactattgttactcaccagacacagtagaaatcacagagaatagtcggacggaggacagctgaccgtcgtagtcagcccaaggctcgcccctcgtcactcctccgtcccaccctcctctcc

SEQ ID NO: 70357 - DNA, 399 bp, Homo sapiens
  misc_feature: GYAE6OF02F88XN.49.26.C04.1.454.CMB.1.raw
  modified_base (392)..(399): a, c, t, g, unknown or other
  misc_feature (392)..(399): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcggctggcaaggcgcatagnnnnnnnn

SEQ ID NO: 70358 - DNA, 540 bp, Homo sapiens
  misc_feature: GYAE6OF02H6SKQ.49.26.C04.1.454.CMB.1.raw
  modified_base (326)..(326): a, c, t, g, unknown or other
  misc_feature (326)..(326): n is a, c, g, or t
  modified_base (396)..(396): a, c, t, g, unknown or other
  misc_feature (396)..(396): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaaatatgactttgttggtaccagaagaagtcaggccaggcccccggtgttgctcatctatgacgacagaaaacgacctccgggatcccngagagattctctggcctccacctcagggaccatggccacgttgactatcagcggggcccagggtggaggntggaaggtgactactattgttactcacagacaccagtagaaatcacagaggaattagtcggcggaggaccaagcgtgacccgtctagcacgacccgaaggctcgccccgtacgccactccgtcgttccccgccctccgtctccc

SEQ ID NO: 70359 - DNA, 526 bp, Homo sapiens
  misc_feature: GYAE6OF02G5W7R.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccgtgttgctcatctatgacgacagaaaacgccctcgggatccctgagagattctctggctccacctcagggaccatggccacgttgactatcagcgggcccaggtggaggatgaaggtgactactattgtactcaccagacaccagtacgaaatcaacagagaatacgttcggcgggagggaccaagctgaccgtctaggtcagcccgaaggctcgcccctcggtcacgtctcgttcccacctcctctcc

SEQ ID NO: 70360 - DNA, 396 bp, Homo sapiens
  misc_feature: GYAE6OF02GK8N4.49.26.C04.1.454.CMB.1.raw
  modified_base (393)..(396): a, c, t, g, unknown or other
  misc_feature (393)..(396): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgcccctggtcactctgttcccacctcctctctctcgactctgacgcgggctggcaaggcgcatagnnnn

SEQ ID NO: 70361 - DNA, 518 bp, Homo sapiens
  misc_feature: GYAE6OF02HOMD1.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaaatatgcttgttggtaccagaagaagtcaggccaggccccggtgttgctcatctatgacgacagaaaaccgaccctccgggatccctgagagattctctggctccacctcagggaccatggccacgttgactatcagcgggcccagggtgaggatgagtgactactattgttactcacagacaccagtgaaatcacagagaatagtcggcgaggacaagctgaccgtcagtcagacccaaggcctcgcccctcggtcacgtctcgtcccacctcctctcc

SEQ ID NO: 70362 - DNA, 536 bp, Homo sapiens
  misc_feature: GYAE6OF02F53LM.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgccctccgggatccctgagagattctctggctccacctcagggaccatcggccacgttgactatcaggccggggcccagggtgaggatggaaggtgactactattgttactcaccagacacagtagaaaatcacagagaatagttcggacggaggaccaagctgaccgtcgtagtcacgcccgaaggcctcgcccctcggtcactcgtccgttcccaccctcctcctccc

SEQ ID NO: 70363 - DNA, 186 bp, Homo sapiens
  misc_feature: GYAE6OF02IZBXE.49.26.C04.1.454.CMB.1.raw
  modified_base (173)..(186): a, c, t, g, unknown or other
  misc_feature (173)..(186): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcgggctggcaaggcgcaatagnnnnnnnnnnnnnn

SEQ ID NO: 70364 - DNA, 758 bp, Homo sapiens
  misc_feature: GYAE6OF02H7SC9.49.26.C04.1.454.CMB.1.raw
  modified_base (263)..(263): a, c, t, g, unknown or other
  misc_feature (263)..(263): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
tcagagtcgagagacacgaccggtgctcgatttagtctagcgactttgggtttggggtgggcgtcaggaggcagagctctgggaatctcaccatggcctggaccctctcctgctcccctcctcactttctgcacagtctctgaggcctcctatgagcgtgacgacacgccacccgtcggtgtcggtcgtccccgaggacgaaacgccaggataacctgctcgtggagatgcattgaccaaaaatctgcttgtggtaccagaanaagtcaggccaggacccgngtgntacatctatgacacagaaaacgcctacggtactaccctgacgagtacttcgtctggaccttccgaccttacgacgggaaccaacgttcgggaccctaacggtttcggaaccttagttaaccgacgggtacccggggcccgaaacggggtgggtaacggggtaacgtacgggaaaagggtttcgggaaacgtttaaccctaagtttaacggtttaaccgttaacctaacccgtaacgtaaccgaaacccgtaagggttaaacgaaaacgttacaaccgaaacggttaacggggaaaattaacggtttaccggggaacggaaacggggaaccctaagtaccggtacgtaaacccggttacgtaaccgggttacaccggttaacccgtaaacgggacccttccggtaacccccggttccggtaccgtaaccgtcgttacccggtttaccccaacccgttccccgtacttacccgg

SEQ ID NO: 70365 - DNA, 395 bp, Homo sapiens
  misc_feature: GYAE6OF02F11V7.49.26.C04.1.454.CMB.1.raw
  modified_base (392)..(395): a, c, t, g, unknown or other
  misc_feature (392)..(395): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtctaggtcagcccaaggctgccccctggtcactctgttcccacctcctctctctcgactctgagcgggctggcaaggcgcatagnnnn

SEQ ID NO: 70366 - DNA, 580 bp, Homo sapiens
  misc_feature: GYAE6OF02I94LE.49.26.C04.1.454.CMB.1.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
  modified_base (398)..(398): a, c, t, g, unknown or other
  misc_feature (398)..(398): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagcccaccctcggtgtcggtgtccccaggacaaacggccaggataacctgctctggagatgcattgaccaaaaaaatntgcttgttggtaccagaagaagtcaggccaggccccggtgttgctcatctatgacgacagaaacgccctcgggatccngagagattctctggcctccactcgacgggaccagtcggcctagttcgaactatcgaggccggggcccagggtggaggntaggaaggtcgaactacgtattcgttactcaccagacacagtacaaaactcaacgagaaggtaactagttccgggaggacgggaaccaagctacggaccgtccgtaggtccacgcccgaaggtcctccggacccccttcggtactacgttccgttccgttccccaccccttccgtccttccg

SEQ ID NO: 70367 - DNA, 395 bp, Homo sapiens
  misc_feature: GYAE6OF02HL5TT.49.26.C04.1.454.CMB.1.raw
  modified_base (392)..(395): a, c, t, g, unknown or other
  misc_feature (392)..(395): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctctctctctcgactctgagcggctggcaaggcgcatagnnnn

SEQ ID NO: 70368 - DNA, 397 bp, Homo sapiens
  misc_feature: GYAE6OF02GIGJ2.49.26.C04.1.454.CMB.1.raw
  modified_base (389)..(389): a, c, t, g, unknown or other
  misc_feature (389)..(389): n is a, c, g, or t
  modified_base (395)..(397): a, c, t, g, unknown or other
  misc_feature (395)..(397): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctcgttcccgcctcctctctctcgactctgagcgggctggcaaggcncatagnnn

SEQ ID NO: 70369 - DNA, 531 bp, Homo sapiens
  misc_feature: GYAE6OF02IVLW8.49.26.C04.1.454.CMB.1.raw
  modified_base (241)..(241): a, c, t, g, unknown or other
  misc_feature (241)..(241): n is a, c, g, or t
  modified_base (436)..(436): a, c, t, g, unknown or other
  misc_feature (436)..(436): n is a, c, g, or t
  modified_base (496)..(496): a, c, t, g, unknown or other
  misc_feature (496)..(496): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgccctcgggatcccgtgagagattctctggctccacctcacgggaccagtggccacgttgactatcaggccgggcccaggtggaggatgaggtgactatattgtactcaccagacacagtagaaatcaanagagaatagtcgggacgaggaccaagctagaccgtcgtacggtcacggtcccgaaggccncgcccctcgtcnctcttcgtcccnccttcctctcc

SEQ ID NO: 70370 - DNA, 524 bp, Homo sapiens
  misc_feature: GYAE6OF02GAPQU.49.26.C04.1.454.CMB.1.raw
  modified_base (241)..(241): a, c, t, g, unknown or other
  misc_feature (241)..(241): n is a, c, g, or t
  modified_base (514)..(514): a, c, t, g, unknown or other
  misc_feature (514)..(514): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctccgggatccctgagagattctctggctccacctcagggaccatcggccacgttgactatcaggccgggcccagggtggaggatgaaggtgactactattgttactcaccagacacagtgaaatcaacagagaatagttcggacgaggacaagctgaccgtcagtcacgccgaaggctcgcccctcggtcacgtctcgtcccncctcctctcc

SEQ ID NO: 70371 - DNA, 537 bp, Homo sapiens
  misc_feature: GYAE6OF02HHFBF.49.26.C04.1.454.CMB.1.raw
  modified_base (238)..(238): a, c, t, g, unknown or other
  misc_feature (238)..(238): n is a, c, g, or t
  modified_base (371)..(371): a, c, t, g, unknown or other
  misc_feature (371)..(371): n is a, c, g, or t
tcagagtcgagagacacgaccggtgctcgatttagtctagcgactttgggtttgggtggggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgccaaaaaaatntgcttgtggtaccagaagaagtcaggccaggccccggtgttcgctcatctatgacgacaagaaaacgaccctcgggatccccgtagacgagattactctggctccaccgtcacgggaccagtcggccacgttnactatcaaggccgggacccagggtgaggataggaaggtgactactattgtactcaccagacaccagtagaaatcaacagaagaatattcggaggaggaccaagctgacgtctaggcagcccgaaggcctcgccccgtcgtccactcgtcgtccccacctcctctcc

SEQ ID NO: 70372 - DNA, 602 bp, Homo sapiens
  misc_feature: GYAE6OF02JS1A3.49.26.C04.1.454.CMB.1.raw
  modified_base (239)..(239): a, c, t, g, unknown or other
  misc_feature (239)..(239): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaaccgccctaccgggactaccctggagagtattctcgtaggcctccacctcgaagggaccagtcggccacggttgaactatcgacgggccggggcccagggtggagggagtaggaaggtcgaactacgtatttcgtactcaaccaagaccaaccagtagaaaactcaaacaggaaggaaattacgtacgggacgggaagggaaccgagacgtacggacccgttacgtaggtcaacgacccggaacggccttccgccccgtcggtacaccttcgtccgttccccggcccttccttccctccg

SEQ ID NO: 70373 - DNA, 539 bp, Homo sapiens
  misc_feature: GYAE6OF02F07DJ.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgcctccgggatccctgagagattctctggctccacctcagggaccatggccacgttgactatcagcggggcccagggtggaggatgaaggtgactactattgttactcaccagacaccagtagaaaatcacagaaggaatattcggcggaaggaccaagctgaccgtcctaggtcacgcccgaaggcctcgcccccgtcggtccaccttctccgttccccaccctcctcctcc

SEQ ID NO: 70374 - DNA, 527 bp, Homo sapiens
  misc_feature: GYAE6OF02FFAFZ.49.26.C04.1.454.CMB.1.raw
  modified_base (417)..(417): a, c, t, g, unknown or other
  misc_feature (417)..(417): n is a, c, g, or t
  modified_base (458)..(458): a, c, t, g, unknown or other
  misc_feature (458)..(458): n is a, c, g, or t
  modified_base (518)..(518): a, c, t, g, unknown or other
  misc_feature (518)..(518): n is a, c, g, or t
tcagagtcgagagacacgaccggtgctcgatttagtctagcgactttgggtttgggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatctgggggagtcgtggtagagcctggggggtcctgagactctcctgtgcagcctctggattcatctttgatgattatgccatgcactggatccgtcaagctcggggaaggtctggagtgggtctctcttattaattgggatggtgtatcacctactatgcagactctgtgagggtcattcacctatcncagagacaacagcagaactcctgtactctgacaaatgaacngtctcagaggtgacgactacccggtcttacgtactacgtgtacgacaaaagtcttacggnaccctaacg

SEQ ID NO: 70375 - DNA, 538 bp, Homo sapiens
  misc_feature: GYAE6OF02HJYOV.49.26.C04.1.454.CMB.1.raw
  modified_base (455)..(455): a, c, t, g, unknown or other
  misc_feature (455)..(455): n is a, c, g, or t
  modified_base (523)..(523): a, c, t, g, unknown or other
  misc_feature (523)..(523): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaaacgaccctccgggatcccctgacgagattctctggctccacctcagggaccatggccacgttgactatcagcgggcccagggtggaggatgaaggtgacgtactattgttactcaccagacacagtagaaaatcacagagaatattcggnggagggaccaagctgaccgtacgtaggtcagcccaaggctcgccccctcggtcacctctcgttccccncccgttcctccttcc

SEQ ID NO: 70376 - DNA, 545 bp, Homo sapiens
  misc_feature: GYAE6OF02F2RDH.49.26.C04.1.454.CMB.1.raw
  modified_base (241)..(241): a, c, t, g, unknown or other
  misc_feature (241)..(241): n is a, c, g, or t
  modified_base (408)..(408): a, c, t, g, unknown or other
  misc_feature (408)..(408): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctccgggatccctgagagattctctggctccacctcgagggaccagtcggcctacgttgactatcgaggccggggcccagggtggagagggggggtanaaggtgactactattgttactacaccagacacagtagaaatacacagagaatagtcggacggaggacgaagctacgacgtcgtagtcacgccgaaggctcgccccgtcgtcacgtctccgttcccgccctcctctcc

SEQ ID NO: 70377 - DNA, 436 bp, Homo sapiens
  misc_feature: GYAE6OF02GY66J.49.26.C04.1.454.CMB.1.raw
  modified_base (416)..(436): a, c, t, g, unknown or other
  misc_feature (416)..(436): n is a, c, g, or t
tcagagtcgagagacacgaccggtgctcgatttagtctagcgactttggggtttgggggaggatgcattgccaaaaaaatatgcttgttggtacccagaagaagtcaggccaggccccggtgttgctcatctatgacgacagaaaacgaccctccgggatccctgagagtattctctggctccacctcagggacccatgggcccacggttgactatcaggccggggcccagggtggaggatgaaggtgaactactattgttactcaccagacacctagtgaaaatcacagaggaatatcggacggacgggaccaagcgtgaccgtctaggtcaggcccgaaggcgtcgccccctggtcacgtctcgttccccacctcctctctctcgactctgagcgggctggcaaggcgcatagnnnnnnnnnnnnnnnnnnnnn

SEQ ID NO: 70378 - DNA, 648 bp, Homo sapiens
  misc_feature: GYAE6OF02FYEUX.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggccttcctatgagcttgacacagccaccctcggtgtcggtgtccccaggacaaacggccaggataacctgctcgtggagatgcattgaccaaaaaatntgcttgttgtaccagaagagtcaggccaggccccgtgttgctcatctatgacgacaagaaaaccgcccgtccgggatcccgtgacgagactttctcgttcggctccacctcgacgggaacctagtcggacctacggttgactatacgacggccggggacccgagggtggagggactaggaacggtgaacttaacttagtttacgttaactccaaccgacgaccaaccgaagttacgaaaactcaacaggaagtaatagttacggacgggtaacgggaaccaagcctaggtaacccgttacgttacggttccgaacggacccgtaaagggccttaccggtccccccgttagggttacccaaccgttccgttaccggttcccccgtcccgttaccccgtcttccccgg

SEQ ID NO: 70379 - DNA, 464 bp, Homo sapiens
  misc_feature: GYAE6OF02IV25K.49.26.C04.1.454.CMB.1.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (416)..(417): a, c, t, g, unknown or other
  misc_feature (416)..(417): n is a, c, g, or t
  modified_base (419)..(419): a, c, t, g, unknown or other
  misc_feature (419)..(419): n is a, c, g, or t
  modified_base (421)..(464): a, c, t, g, unknown or other
  misc_feature (421)..(464): n is a, c, g, or t
tcagagtcgagagacacgaccggtgctcgatttagtctagcgactttgggtttggggagtattggctattgccgaaaaaaatatgcttgttggtaccagaacgaagtcacggccaggccccggtgttggcctcgactctatgaccgacagaaaacgaccctccgggatcccctgagagagttctctggctccacctnagggaccatggccagttgacctagtcagcggggcccaggtggaggatgaaggtnactactattgttacncacagacaccagtgaaaactcacagacggaaatattacggcggtaggaccaagctgaccgtcctaggtcagcccgaaggctgcccccttggtccactctgttccctacctcctactctcctcgactctgcgcgggctgcaggcgcatagnngntnnnnnnnnnnnnnnnnnnnnnnnnnnnnnnnnnnnnnnnnnnnn

SEQ ID NO: 70380 - DNA, 609 bp, Homo sapiens
  misc_feature: GYAE6OF02GS2WO.49.26.C04.1.454.CMB.1.raw
  modified_base (417)..(417): a, c, t, g, unknown or other
  misc_feature (417)..(417): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttggggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagcgtccggggaagggtctggagtgggtctctcttattaagttggatggtggtatctacctatatgcagactctgtggaagggtcgtattccacctatcctaccagganaaccaacagaccaacgaaacctcccgtagtactctacgacaaagtcgaaactacgtctacgaaggtaggtagaacggacctaccgtccctttatacccttagtacggtacgaaaccaaaaggtacgttaaccggggtactaaccccgaacttaacccgttttagtttttaccgaacccgttaccgtaccggg

SEQ ID NO: 70381 - DNA, 399 bp, Homo sapiens
  misc_feature: GYAE6OF02HWCKF.49.26.C04.1.454.CMB.1.raw
  modified_base (397)..(399): a, c, t, g, unknown or other
  misc_feature (397)..(399): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcaacagaggaatattcggcggagggaccaagctgaccgtcctaggtcagcccaaggctcgccccctcggtcactctcgttcccgccctcctctctctcgactctgagcgggctggcaggcgcatgnnn

SEQ ID NO: 70382 - DNA, 400 bp, Homo sapiens
  misc_feature: GYAE6OF02G3ESY.49.26.C04.1.454.CMB.1.raw
  modified_base (394)..(400): a, c, t, g, unknown or other
  misc_feature (394)..(400): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcgggctggcaagggcgcatagnnnnnnn

SEQ ID NO: 70383 - DNA, 402 bp, Homo sapiens
  misc_feature: GYAE6OF02HF28S.49.26.C04.1.454.CMB.1.raw
  modified_base (397)..(402): a, c, t, g, unknown or other
  misc_feature (397)..(402): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgaaagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctcgttccccaccctcctctctctcgactctgagcgggctggcaaggcgcatagnnnnnn

SEQ ID NO: 70384 - DNA, 596 bp, Homo sapiens
  misc_feature: GYAE6OF02HJ1VV.49.26.C04.1.454.CMB.1.raw
  modified_base (421)..(421): a, c, t, g, unknown or other
  misc_feature (421)..(421): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcgtgggttttccttgttgctattttaaaaggtgtccagtgtgaagtgcagttggtggaatctgggggagtcgtggtagagcctggggggtccctggagactctcctgtgcagcctctggattcatctttgatgattatgccatgcactggatccgtcaagcgtccggggaggtctggagtgggtctctcttattaagtgggatggtgtatcactacatgcagactctgtggaagggtcgattccaccgattcctaccagacgaacaaacngaccaacgaaaccttcccttagtacttcgagacctaaaattcgaaacctagttctacgaggtaggttacgaacggaccgacccgttcccttactaccttacgtcggtacgaacgtaaaaggtcgtttaacggacgaaccctaacgtaccgtttattttacgaccctacgtacggg

SEQ ID NO: 70385 - DNA, 398 bp, Homo sapiens; identical to SEQ ID NO: 70352
  misc_feature: GYAE6OF02HWXWY.49.26.C04.1.454.CMB.1.raw
  modified_base (394)..(398): a, c, t, g, unknown or other
  misc_feature (394)..(398): n is a, c, g, or t

SEQ ID NO: 70386 - DNA, 401 bp, Homo sapiens
  misc_feature: GYAE6OF02HOPDJ.49.26.C04.1.454.CMB.1.raw
  modified_base (396)..(401): a, c, t, g, unknown or other
  misc_feature (396)..(401): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgcccctggtcactctcgttcccaccctcctctctctcgactctgacgcgggctggcaaggcgcatagnnnnnn

SEQ ID NO: 70387 - DNA, 692 bp, Homo sapiens
  misc_feature: GYAE6OF02FRI8J.49.26.C04.1.454.CMB.1.raw
tcagagtcgagagacacgaccggtgctcgatttagtctagcgactttgggtttgggggtggggctcaggaggcagagcgtctgggaatctcaccatggcctggaccctctcctcgctccccctcctcactttctgcacagtctctgaggcctcctatgagctgacacacgccaccctcggtgtcggtcgtccccaggacaaacggccaggataacctgctctggagatgcattgaccaaaaaatatagcttgttggtaccagaagaagtcaggccacggccccggtgttcgctcatctatagacgacgaaggaaaccgcccgtaccgggactcccgtgacgagtacttactcgtacggccttaccgacctcgaacgggaccagtcggacctaacgttcgaactactacgacggccggggacccgtagggtacggacgggacgttaggaagggttacgaacgttacgttagttacgttaacctactaaccgacggtaacctaaccgtaagttacggaaaactcgaacgaagggaaggtaaacttacgttcgggaacgggtacgggaaccgtaaggccgtaacggaccggttaccgtaaggtaccgacggaccccggtaaggtcccgtaccggtacccccgtcggtaaccacccgttccgttacccggttccccccaccttccctacttccccg

SEQ ID NO: 70388 - DNA, 515 bp, Homo sapiens
  misc_feature: GYAE6OF02F1LM2.49.26.C04.1.454.CMB.1.raw
  modified_base (307)..(307): a, c, t, g, unknown or other
  misc_feature (307)..(307): n is a, c, g, or t
  modified_base (395)..(395): a, c, t, g, unknown or other
  misc_feature (395)..(395): n is a, c, g, or t
  modified_base (464)..(464): a, c, t, g, unknown or other
  misc_feature (464)..(464): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (479)..(479): a, c, t, g, unknown or other
  misc_feature (479)..(479): n is a, c, g, or t
  modified_base (495)..(495): a, c, t, g, unknown or other
  misc_feature (495)..(495): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
tcagagtcgagagacacgaccggtgctcgatttagtctagcgactttgggtttggggggagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatctgggggagtcgtggtagagcctggggggtccctgagactctcctgtgcagcctctggattcatctttgatgattangccatgcactggatccgtcaagctccggggaaggtctggagtgggtctctcttattaattgggatggtgtatcactatatgcagactntgtgaagggtcattcaccatcctccagagacaacagcaagaaacctccctgtactctgacaaatgaacngtctnagngtgagcncgccttcactactganacaaagnttacggnacctac

SEQ ID NO: 70389 - DNA, 552 bp, Homo sapiens
  misc_feature: GYAE6OF02IJ3RJ.49.26.C04.1.454.CMB.1.raw
  modified_base (438)..(438): a, c, t, g, unknown or other
  misc_feature (438)..(438): n is a, c, g, or t
tcagagtcgagagacacgaccggtgctcgatttagtctagcgactttgggtttgggggtgggctcaggaggcagagctctgggaatctcaccatggcctggacccctctcctgctcccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgccctccgggatccctgagagattctctggctccacctcgacgggaccagtcggcctacgttgactatcaggccggggcccagggtggaggagtggaaggtgactactattgttacacacagacacaganaaatcaacagagaatagttcggacggaagggacaagcgtagaccgtacctaggtcacggcccgaaggcctcgccccgttcggtccactccttccgtccccgtccctcctctccc

SEQ ID NO: 70390 - DNA, 411 bp, Homo sapiens
  misc_feature: GYAE6OF02G0ET4.49.26.C04.1.454.CMB.1.raw
  modified_base (395)..(411): a, c, t, g, unknown or other
  misc_feature (395)..(411): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaaatcacagaggaatattcggcggagggaccaagctgaccgtcctaggtcagcccaaggctgccccctggtcactctgttcccacctcctctctctcgactctgagcgggctggcaaggcgcatagnnnnnnnnnnnnnnnnn

SEQ ID NO: 70391 - DNA, 534 bp, Homo sapiens
  misc_feature: GYAE6OF02JINZH.49.26.C04.1.454.CMB.1.raw
  modified_base (298)..(298): a, c, t, g, unknown or other
  misc_feature (298)..(298): n is a, c, g, or t
  modified_base (527)..(527): a, c, t, g, unknown or other
  misc_feature (527)..(527): n is a, c, g, or t
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtgggggtccctgagactctcctgtgcagcctcgtggattctanttttgatgattatgcccatgcactggatccgtcaagctccggggaagggtctggagtgggtctctcttattaaattggggatggtgggtatcacctatatgcagactctgtgaagggtcgattcaccatctccagagacaacagcaagaaactccctatatctgacaaatgaaacagtctacagagtgaggaccaccgtcttcactactgtcgacaaaagattacgganactaacc

SEQ ID NO: 70392 - DNA, 433 bp, Homo sapiens
  misc_feature: GYAE6OF02HZ4GQ.49.26.C04.1.454.CMB.1.raw
  modified_base (413)..(433): a, c, t, g, unknown or other
  misc_feature (413)..(433): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaacgaccctccgggatccctgagagattctctggctccactcagggaccatggccacgttgactatcagcggggcccaggtggaggatgaaggtgactactattgttaactcaccagaacaccagtgaaaaatcaacaagaggaatattcggcggagggaccaaagctgaccgtcctaggtcagcccaaggctcgccccctcgtccactctgttccccaccctcctctctctcgactctgacgcgggctggcaaagggccgacactaagcannnnnnnnnnnnnnnnnnnnn

SEQ ID NO: 70393 - DNA, 397 bp, Homo sapiens
  misc_feature: GYAE6OF02GEOL0.49.26.C04.1.454.CMB.1.raw
  modified_base (395)..(397): a, c, t, g, unknown or other
  misc_feature (395)..(397): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccgccctcctctctctcgactctgagcgggctggcaaggcgcatagnnn

SEQ ID NO: 70394 - DNA, 407 bp, Homo sapiens
  misc_feature: GYAE6OF02IT6I3.49.26.C04.1.454.CMB.1.raw
  modified_base (353)..(353): a, c, t, g, unknown or other
  misc_feature (353)..(353): n is a, c, g, or t
  modified_base (396)..(407): a, c, t, g, unknown or other
  misc_feature (396)..(407): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggccacgttgactatcagcgggccaggtggagatgaaggtgactactatgttactcacagcaccagtgaaaatcacaagaggaatattcggcggaggaccaagctgaccgtcgtagtcagcccaaggctcgccccctggcactctcgttcccacccttcctntcctctccgactcctgacgtcgggctggctaaggcgcagtcgnnnnnnnnnnnn

SEQ ID NO: 70395 - DNA, 542 bp, Homo sapiens
  misc_feature: GYAE6OF02F7LFJ.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagcgtccggggaaggtctggagtgggtctctcttattatgggatggtgtatcacctatatgcagactctgtagagggtcatcacatctcagagacaacagaccagaaaccttccctagtactcagacaaatgaaactagtcacagaggtgacggacaccgtccttactactacgtgtcgaactaaaagtcttaacggagaacccactaacccttattttaccgacctacgtacgg

SEQ ID NO: 70396 - DNA, 597 bp, Homo sapiens
  misc_feature: GYAE6OF02IWOTO.49.26.C04.1.454.CMB.1.raw
  modified_base (243)..(243): a, c, t, g, unknown or other
  misc_feature (243)..(243): n is a, c, g, or t
  modified_base (591)..(591): a, c, t, g, unknown or other
  misc_feature (591)..(591): n is a, c, g, or t
tcagagtcgagagacacgaccggtgctcgatttagtctagcgactttgggtttgggggtgggctcaggaggcagagctctgggaatctcaccatggcctggacccctctcctgctcccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaaccgcccgtcgggactccctgagagattctctggctccacctcacgggaccagtcggcctacgttcgactagtcgaggtccggggcccgagggtaggaggacgtagggaaaggtgaactaacgttatttacgtttacctacaacccgaagacctaacgagtaacaaaatcaacaggaagaattagtacgggacggaagggacaagcgtacgaccgtcgtagtcaacgaccgaacggtctccggtccccgtcgtcacgttccgttaccgtcccccgtcccttcccnccttcc

SEQ ID NO: 70397 - DNA, 580 bp, Homo sapiens
  misc_feature: GYAE6OF02FU88T.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacgcagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaaccgcctccgggatcccgtgagagacttctctggctccacctcgacgggaccagtcggcctacgtttcgactatcgaggcggggcccagggtggaggtataggaaggtgactactattgttactcaccagacaccagtagaaactcaacgagaaggtaatagttccgggacggaagggaacccaaggctacggaccgtccgttagggtcacggacccgaagggcctccggccccctcggtccacgttcctaccgttccccacccttcctcccttcc

SEQ ID NO: 70398 - DNA, 598 bp, Homo sapiens
  misc_feature: GYAE6OF02IKFC3.49.26.C04.1.454.CMB.1.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtgtcggtgtccccaggacaaacggccaggataactgctctggagatgcattgaacaaaaaaatntgcttgttggtacagaagaagtcaggccaggcccggtgtgctcatctatgacgacaagaaaaccgacctccggatccngagagattctctcggctaccacctacgacgggaccagtcggaccacgttgacttancgacgcgggcccagggtcggaggagtggaagtgactactattagtactcacagacacagtagaaatcacaggaagtaatacgttacggacggacgggaaccgaagacgtacggaaccctacgtacggtaccgaacggacccgaaacgggtaccttccggacccccgttaccggtacctacccgttccgttacccgttccccgtaaccccgtcccttccgttaccc

SEQ ID NO: 70399 - DNA, 695 bp, Homo sapiens
  misc_feature: GYAE6OF02GMG7C.49.26.C04.1.454.CMB.1.raw
  modified_base (254)..(254): a, c, t, g, unknown or other
  misc_feature (254)..(254): n is a, c, g, or t
tcagagtcgagagacacgaccggtgctcgatttagtctagcgactttgggtttggggttggggcgtcaggaggcagagcctctgggaatctcaccactggcctggaccctctcctgcctcccctcctcactttctgcacagtctctgaggcctcctatgagctgacacagccaccctcggtcgtcggtcgtcccaggacgaaacggaccaggactaacctgctcgtggaggactgcattagacctaaaaaaatntagtcgttgttacggtaccaagaaagaacgtcgaggccgacggtccccggtgttcgctcatctatgacgacaacgaaaaccgacccgtaccgggacgtccccgtaggacgacgtacttccgtcgtcggtcctccgtaccgtcgaacgggtaccgtagtcggaccgtacggttcgaacttacgtcgacggccggggaccctagggtacggacggagtaggaaggtcgtaacgtaacgttagttacgtactaccacgacgaacgtaccgtaagttacgtaaaactcgaactaaggaagtaagtacgtttacgggacggtaaggtaccaagtaccgtacgaaccggtaccgtaggtaccgacggtaacccgaaggtcctacccggtaccccgtacggtccgtacgttccggttaccgttaccccgtacccttccgtaccttccg

SEQ ID NO: 70400 - DNA, 568 bp, Homo sapiens
  misc_feature: GYAE6OF02G3E3V.49.26.C04.1.454.CMB.1.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctgganatgcattgaccaaaaaaatntgcttgttggtaccagaagaagtcaggccaggccccggtgttgctcatctatgacgacaagaaaacgacccctccgggactcccgtgagagattctctggcctccacctcgaacggggaccagtcggcctacgttcgaacttatccgaacggccggggcccaggggtggaggagtaggaaggtgaactacttattgttactcaccagacacagtagaaatcaacagaagaatagtcggaggaggacaagcgtacgaccgtctaggtcagacccgaaggcctccggcccctcggtccacgttcgtccgtccccgtccctcctctcccg

SEQ ID NO: 70401 - DNA, 400 bp, Homo sapiens
  misc_feature: GYAE6OF02GSHZE.49.26.C04.1.454.CMB.1.raw
  modified_base (395)..(400): a, c, t, g, unknown or other
  misc_feature (395)..(400): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctcggtcactctgttcccacctcctctctctcgactctgagcgggctggcaaggcgcatagnnnnnn

SEQ ID NO: 70402 - DNA, 523 bp, Homo sapiens
  misc_feature: GYAE6OF02FRO1O.49.26.C04.1.454.CMB.1.raw
  modified_base (490)..(490): a, c, t, g, unknown or other
  misc_feature (490)..(490): n is a, c, g, or t
  modified_base (501)..(501): a, c, t, g, unknown or other
  misc_feature (501)..(501): n is a, c, g, or t
  modified_base (513)..(513): a, c, t, g, unknown or other
  misc_feature (513)..(513): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaattgcttgttggtaccagaagaagtcaggccaggccccggtgttgctcatctatgacgacagaaaacgccctcgggatcccgtgagagattctctggctccacctcagggaccagtcggccacgttgactatcgagcggggcccagggtggaggagtggaaggtgacgtactattgttactcacagacacgagtagaaatcacagagaatagtcggcggaggaccaagctagaccgtctagcagccaaggcncgcccctgtcnctctcgttcccncctcctctcc

SEQ ID NO: 70403 - DNA, 403 bp, Homo sapiens
  misc_feature: GYAE6OF02GO8KA.49.26.C04.1.454.CMB.1.raw
  modified_base (391)..(391): a, c, t, g, unknown or other
  misc_feature (391)..(391): n is a, c, g, or t
  modified_base (397)..(403): a, c, t, g, unknown or other
  misc_feature (397)..(403): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctcgccccctggtccactctcgttcccacctcctctctctcgactctgagcgggctggcaaggcncatagnnnnnnn

SEQ ID NO: 70404 - DNA, 411 bp, Homo sapiens
  misc_feature: GYAE6OF02HCT5H.49.26.C04.1.454.CMB.1.raw
  modified_base (403)..(411): a, c, t, g, unknown or other
  misc_feature (403)..(411): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggccaggtggaggatgaaggtgactactattgttactcaccagacaccagtgaaaatcacagaggaatagttcggcggagggaccaagctgaccgtcctaggtcagcccaaggctcgcccctggtcactctcgtcccacctcctctctctcgactcgtgacgcggctcggacgaacggcgacagtacgnnnnnnnnn

SEQ ID NO: 70405 - DNA, 759 bp, Homo sapiens
  misc_feature: GYAE6OF02IP5ED.49.26.C04.1.454.CMB.1.raw
  modified_base (222)..(222): a, c, t, g, unknown or other
  misc_feature (222)..(222): n is a, c, g, or t
  modified_base (290)..(290): a, c, t, g, unknown or other
  misc_feature (290)..(290): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtcgtccccaggacaaacggccaggataacctgctctgganatgcattgaccaaaccgatatgtcttattcggtaccagcagaacgccgggacacggccctgtgttggngatgtaataaagacactggagacggccctagagggactcccgtagacgcgtattcctcgtggccttaccgaggtcgaacgggaaccaacggtcaactagttcggaccaagtcgtaggtcggtacgtaccgagggacgaaggagggaacggaggaccgtaggtaaccttaagtttagtttacggtaactaaacgttaccaaacgtaacgtaaccctaaccttaacggttttacgggttaaactttacgttacggtttaccgtttaaccgggtaaactttacggggaccgtaaaaccccggtaagggtttaccccgaccccgggttttaccggttacccgggggtaacctaacccgggtacccccggtaaaaccgggaaccccccgtaaaacccccccgttacgttaaccccggttacccgtaaccccggtttccccggttttaccccgggttcccccccggttacccccc

SEQ ID NO: 70406 - DNA, 400 bp, Homo sapiens
  misc_feature: GYAE6OF02G303C.49.26.C04.1.454.CMB.1.raw
  modified_base (396)..(400): a, c, t, g, unknown or other
  misc_feature (396)..(400): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcaacagaggaatattcggcggagggaccaagctgaccgtcctaggtcagcccaaggctcgccccctggtcactctgttcccacctcctctctctcgactctgagcgggctggcaaggcgcatagnnnnn

SEQ ID NO: 70407 - DNA, 563 bp, Homo sapiens
  misc_feature: GYAE6OF02GN8M9.49.26.C04.1.454.CMB.1.raw
  modified_base (406)..(406): a, c, t, g, unknown or other
  misc_feature (406)..(406): n is a, c, g, or t
  modified_base (465)..(465): a, c, t, g, unknown or other
  misc_feature (465)..(465): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcattctttgatgattatgccatgcactggatccgtcaagcgtccggggaagggtctgggagtgggtctctcttaattaagttgggatggtggtatcacctatatgcagctctgtaggagggtcattcaccatccnccagacgacaacagcaacgaaaccttcccgtattactctagacaaatcgaaacagtcanaggaggtgaacggaccaccgtccttacttaccacgtggtacgaacaaaaggtcttaacggtcaaccctaactacctttacgtttacgacctacgtcgg

SEQ ID NO: 70408 - DNA, 581 bp, Homo sapiens
  misc_feature: GYAE6OF02FLT2Z.49.26.C04.1.454.CMB.1.raw
  modified_base (469)..(469): a, c, t, g, unknown or other
  misc_feature (469)..(469): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcgtgggttttccttgttgctattttaaaaggtgtccagtgtgaagtgcagttggtggaatctgggggagtcgtggtagagactggggggtccctgagactctcctgtgcagcctctggattcatctttgatgattatgccatgcactggatccgtcaagcgtccggggaagggtctgggagtgggtctctcttattaattgggatggtggtatcacctactatgcagctctgtggaagggtcgactcacatcctacgagacgacaacagacaagtaaacctccctagtactctagacaaatgaactagtactcaaggnggtagacggacctaaccgtccttacttactacgtagtacgaacgaaaaacggtagtttacccgggtacgaaccctaaccttacctttacttttacgaaccccttagtccggg

SEQ ID NO: 70409 - DNA, 400 bp, Homo sapiens
  misc_feature: GYAE6OF02F9MCP.49.26.C04.1.454.CMB.1.raw
  modified_base (395)..(400): a, c, t, g, unknown or other
  misc_feature (395)..(400): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccaccctcctctctctcgactctgacgcggctggcaaggcgcatagnnnnnn

SEQ ID NO: 70410 - DNA, 550 bp, Homo sapiens
  misc_feature: GYAE6OF02FRZDV.49.26.C04.1.454.CMB.1.raw
  modified_base (242)..(242): a, c, t, g, unknown or other
  misc_feature (242)..(242): n is a, c, g, or t
  modified_base (425)..(425): a, c, t, g, unknown or other
  misc_feature (425)..(425): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataaccctgctctggagatgcattgaccaaaaaaatntagcttgttggtaccagaagaagtcaggccaggccccggtgttgctcatctatgacgacagaaaacgccctcgggatccctgagagattctctggctccacctcagggaccatcggccagttgactatcagcgggccagggtgaggatgaaggtgactatattgtactcaccagacacagtanaaatcacagagaatagttcggacgaggacaagctagaccgtaccgaggtcacggacccgaaggcctaccgcccccgtcggtcctaccgttccgttccgttaccccgccccttacctcccttcccg

SEQ ID NO: 70411 - DNA, 400 bp, Homo sapiens
  misc_feature: GYAE6OF02H7K6T.49.26.C04.1.454.CMB.1.raw
  modified_base (389)..(389): a, c, t, g, unknown or other
  misc_feature (389)..(389): n is a, c, g, or t
  modified_base (395)..(400): a, c, t, g, unknown or other
  misc_feature (395)..(400): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaaggctgaccgtcctaggtcagcccaaggctcgccccctggtcactctcgttcccacctcctctctctcgactctgagcggctggcaggcncatagnnnnnn

SEQ ID NO: 70412 - DNA, 574 bp, Homo sapiens
  misc_feature: GYAE6OF02GAMZV.49.26.C04.1.454.CMB.1.raw
  modified_base (240)..(240): a, c, t, g, unknown or other
  misc_feature (240)..(240): n is a, c, g, or t
  modified_base (458)..(458): a, c, t, g, unknown or other
  misc_feature (458)..(458): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgttggtaccagaagagtcaggccaggccccgtgttgctcatctatgacgacaaggaaaacgaccccgtaccgggactccctgagagattctctggctccacctcgagggaccagtcggcctaacggttcgactatcgaggccggggcccgagggtggaggagtaggaaggtgactactattcgttactcaccagacaccagtaagaaatcganagaagtaatacgtggacggaggaccaagctacgaccgtcgtaggtcacgaccgaaggcctccggcccccttggaccctaccgtccgttccttccccgtaccccttcccgtctcccg

SEQ ID NO: 70413 - DNA, 521 bp, Homo sapiens
  misc_feature: GYAE6OF02FU48G.49.26.C04.1.454.CMB.1.raw
  modified_base (327)..(327): a, c, t, g, unknown or other
  misc_feature (327)..(327): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
  modified_base (478)..(478): a, c, t, g, unknown or other
  misc_feature (478)..(478): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtnaagcgtccggggaagggtctggagtgggtctctcttattaattgggatggtggtatcactactatgcagactntgtgaagggtcattcactatctcaganacangcagaactcctgtatcngacaaatgaacntctacagaggtgaggacncccggccttctacctatgtgaacaaagtnttacggtnacctac

SEQ ID NO: 70414 - DNA, 568 bp, Homo sapiens
  misc_feature: GYAE6OF02FSPOS.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctctggattcatctttgatgattatgccatgcactggatccgtcaagccgtccggggaagggtcgtggagtgggtctcttcttattaatgggatggtggtatcaccttactatgcagactctggtgaagggtcgattcaccatcaccagagacaacagacaagaaaccttccctagttatccgtagactaaatgaaacagtctagaagtaggtagaaggaccacccgtccttacctactacgtagtcgaaccaaaggtacttacggtacaaccctactacctttagttttacgacccctatccgg

SEQ ID NO: 70415 - DNA, 733 bp, Homo sapiens
  misc_feature: GYAE6OF02HXR9O.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtgtcggtgtccccaggacaaacggccaggataacctgctctggagatgcattgaaccaaaaaaatntgcttgtgtacagaagaagtcaggccaggccccggtgttcgctcatctatcgacgacaagaaaaccgaccctacgggactccctgacgagtacttactcgtggcctccacctacgacgggaccacgtcggaccgtacgtttacgaacttactacgacggtccggggacccgtaggggtacgggaacgggtagtacgggaacgggtacggtaaccgttaacgttagttttacggttaaccgttaccgaacccgtaaacggaaccgtaaacccgtaaggtaaacgtaaaaactaccgaaacgaacgggtaaacggtaaacgttaacggttaccggggaccggggtaaacgggaaacccgtaagtaccggttacggaacccgttaccgtaacggttaccgacggtacccggaaaggtcccgtaccggtacccccggttcgtaccgtacccgttacggttcccgttaccccggtccctacccgttcccgttacccg

SEQ ID NO: 70416 - DNA, 639 bp, Homo sapiens
  misc_feature: GYAE6OF02GBRFF.49.26.C04.1.454.CMB.1.raw
  modified_base (295)..(295): a, c, t, g, unknown or other
  misc_feature (295)..(295): n is a, c, g, or t
tcagagtcgagagacacgaccggtgctcgatttagtctagcgactttgggtttgggggctctgggaaaggagccccagccctgagattcccagggtcgtttccattcggtgatcgagcactgaacacagaactcaccatggagtttgggctgagctgggttttccttgttgctattttaaaaggtgtccagtgtgaagtgcagttggtggaatcgtgggggagtcgtggtagagcctggggggtccctggagactctcctgtgcagcctctggtattcgatctttgatgattaangaccatgccagtgatccgtcaaggtccgtaccggggaaggtcgtggaggttgggtctctcgttagttaagttgggatggtagtatctacctacgtatgcagtactctacggtaggtaacgggtcgtacttaccgaactactccctaccgaaggtacgaaacaaacgacgaccgaacgtaaaccttccctagtaactcgtagtaactaagtacgaacctagtcgtacgaggtacgtagaacggtacgaccgtccttaacgtacgtacgtaggtacgaacgtaaacgtacgttaaccggactaacccgtaactacccgtttaactttccggaaccctcgtacccgg

SEQ ID NO: 70417 - DNA, 420 bp, Homo sapiens
  misc_feature: GYAE6OF02JIOUT.49.26.C04.1.454.CMB.1.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (293)..(293): a, c, t, g, unknown or other
  misc_feature (293)..(293): n is a, c, g, or t
  modified_base (397)..(397): a, c, t, g, unknown or other
  misc_feature (397)..(397): n is a, c, g, or t
  modified_base (403)..(404): a, c, t, g, unknown or other
  misc_feature (403)..(404): n is a, c, g, or t
  modified_base (406)..(420): a, c, t, g, unknown or other
  misc_feature (406)..(420): n is a, c, g, or t
tcagagtcgagagacacgaccggtgctcgatttagtctagcgactttgggtttggggagatgcattgccaaaaaataatgcttgttggtaccagaagaagtcaggccaggccccggtgttgctcatctatgacgacagaaaacgaccctccgggatccctgagagattctctggctccacctcgagggaccatggcccacggttgacctatcaggccggggcccagggtggagatgaaggtgactactattgtaccncaccagacaccagtnaaaatcacagagaatatcggngaggacagctgacgtctaggtcagcccaaggctcgccccctggtccacgtcctcgttcccgccctcctctctccgtcgacctctgacggcggctcggcacggcncatcgnncnnnnnnnnnnnnnnn

SEQ ID NO: 70418 - DNA, 396 bp, Homo sapiens
  misc_feature: GYAE6OF02IC69J.49.26.C04.1.454.CMB.1.raw
  modified_base (388)..(388): a, c, t, g, unknown or other
  misc_feature (388)..(388): n is a, c, g, or t
  modified_base (394)..(396): a, c, t, g, unknown or other
  misc_feature (394)..(396): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcaacagaggaatattcggcggagggaccaagctgaccgtcctaggtcagcccaaggctgccccctcggtcactctgttcccgccctcctctctctcgactctgagcggctgcaggcncatagnnn

SEQ ID NO: 70419 - DNA, 620 bp, Homo sapiens
  misc_feature: GYAE6OF02JELRM.49.26.C04.1.454.CMB.1.raw
  modified_base (378)..(378): a, c, t, g, unknown or other
  misc_feature (378)..(378): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcattctttgatgattatgccatgcactggactccgtcaagctccgggggaaggtctggagtgggtctctcttattagttgggatggtgtatcacctatatgcagctntgtggaagggtctattccacctatctaccaggacacaacagacaacgtaaacctcccgtatactctagactaaatacgaactagttactacgaacggtagggttacgaacgggaacccaacccggttccctttaccgtaccgttaccgtaggttacggaaaccttaaaaagggtacgtttacccgggtacgaacccctaaccgtaacccttttagttttaccgaacccgttacgtacccggg

SEQ ID NO: 70420 - DNA, 629 bp, Homo sapiens
  misc_feature: GYAE6OF02G9U8C.49.26.C04.1.454.CMB.1.raw
tcagagtcgagagacacgaccggtgctcgatttagtctagcgactttgggtttgggggcgtctgggaaaggagccccagcccttgagattcccaggtgtttccgtagttcggtggatcagacaactgaacacagaactcaccatggagtttgggctgtacgctgggttttccttgttgctattttaaaggtgtccagtgtgagtgcagttggtggaatcgtggggagtcgtggtagagccgtggggggtccctgagactctcctgtgcagcctctggattcattctttgatgattatgccatgcactggatccgtcaagccgtccgggggaaggtctgggagtgggtctctcttattaagttgggatggtgtatcacctatatgcagactctgtaggaagggttcgattcacctatctaccagagacaacagacaagaaaccttccctagttactcttacgactaaactcgaaacgtagtcctacgaggtaagggttcggaacggtacccgaacccggttcctttaccttaccgttacttacggttacgaaccgttaaaaaggtacgtttaaccgggtacgaaccccgtaacctaacctttaacgtttttacgaacccttacgtaccgg

SEQ ID NO: 70421 - DNA, 579 bp, Homo sapiens
  misc_feature: GYAE6OF02HNHEI.49.26.C04.1.454.CMB.1.raw
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctctggattcatctttgatgattatgccatgcactggatccgtcaagcgtccggggaaggtcgtggaggtgggtctctcttattaatgggatggtgtatcacctatatgcagactctgtgaagggtcgattccacntctcaganacaacngacaagaaaccttcctagtactctagactaaatcgaaactagtcctacgaaggtagggttagaacgggaccaccgttccttcgtactacgtgtaacgaactaaaaaggtactttaaccggacgaaccctaacgtaacctttaagttttaccgaccctagtaccggg

SEQ ID NO: 70422 - DNA, 623 bp, Homo sapiens
  misc_feature: GYAE6OF02IMXES.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctctggattcattctttgatgattatgccatgcactggactccgtcaagccgtccgggggaaggtctggaggtggtctctcttatagttgggatggtgtatcactactatgacagtactctggtaggacgggtcgtatttccgacctatcctaccgagtaacgaaccaaacgacgaccaaacgtaaacccttcccgttagtattccgtagacctaaagtcgaaacctgttcgtacgaggtaggtgaacgggtaccctaccggtaccctttacgtacgttaacgttcggaactaaccgtaaaagtcgtttaaccggtaccgaaccctacgttacccttaaggttttcaccctagtcccggg

SEQ ID NO: 70423 - DNA, 404 bp, Homo sapiens
  misc_feature: GYAE6OF02FX2QF.49.26.C04.1.454.CMB.1.raw
  modified_base (390)..(390): a, c, t, g, unknown or other
  misc_feature (390)..(390): n is a, c, g, or t
  modified_base (396)..(404): a, c, t, g, unknown or other
  misc_feature (396)..(404): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagctcaaggctcgccccctggtccactctgttccccgcctcctctctctcgactctgagcggctggcaaggcncatagnnnnnnnnn

SEQ ID NO: 70424 - DNA, 751 bp, Homo sapiens
  misc_feature: GYAE6OF02IOM1V.49.26.C04.1.454.CMB.1.raw
tcagagtcgagagacacgaccggtgctcgatttagtctagcgactttgggtttggggggctctggggaaaggagccccagcccctgagattcccaggtgtttccattcggtgatcagcactgaacacagaactcaccatgggagtttgggctgagctgggttttccttgttgctattttaaaggtgtccagtgtgaagtgcagttggtggaatcgtgggggagtcggtggtagagccgtggggggtccctgagactctcctgtgcagcctctggattcattctttgatgtattatgccatgctacgtggactcccgtacaacggccgtaccggggggaaagggttccgtaggggtacggttggggttccttacgttacgtttagtttaaagttggggtatgggttacggtaattctaacccgttaactaagttcggactaacggtacctttcgtagggttaaggtaacggggttacgtactttacccacccgtaattcccgtaacccaaggaacggaaaccaaacgtaacggactaaacggtaaaccccgttccccgtaggtttaactaccgtaagtaaaccgtaaaacgtacgaaaccgtacggttaccgtacgaaacgggtacggggtagaaccgggaaacctccccgggttaccttaccggtacttaccgtaggtaacaaacgaaaaggttaagttaccggacgtaaccccaactaccgtttagtttaccggaaccttacgtaccggg

SEQ ID NO: 70425 - DNA, 601 bp, Homo sapiens
  misc_feature: GYAE6OF02G2S74.49.26.C04.1.454.CMB.1.raw
  modified_base (372)..(372): a, c, t, g, unknown or other
  misc_feature (372)..(372): n is a, c, g, or t
tcagagtcgagagacacgaccggtgctcgatttagtctagcgactttgggtttgggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatctgggggagtcgtggtagagcctggggggtccctgagactctcctgtgcagcctctggattcattcttgatgattatgccatgcacgtggactccgtcaagcgtccggggaaggtcgtggagtggtctctcttattagtggntggtgtatcactactatgcagactcgtagtgaaggtcattccacattccacgagacgacaacgagaccaagtaaccctcccgttagtacttcctaggaacctaaagtcggaaactcgggttacctaacggtaagggacggttacgggaacgaccccgtaacccggttccctttaacgtaccgttaactggtacgaacgtaaaggtccgtttacggaccaacctaacccg

SEQ ID NO: 70426 - DNA, 539 bp, Homo sapiens
  misc_feature: GYAE6OF02II5QF.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctcccccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtcaggccaggccccggtgttgctcatctatgacgacagaaaaccgaccctccgggatcccctgagagattctctggctccactcagggaccatggccagttgactatcgagccgggccagggtggagatgaaggtgactatattgtactcaccagacaccagtagaaaatcaacagaggaatagttcggacggaagggaccaagctacgaccgtccgtaggtcacggcccgaacggctccgcccctcggtccactctcgtcccaccctcctctcc

SEQ ID NO: 70427 - DNA, 804 bp, Homo sapiens
  misc_feature: GYAE6OF02G3OGS.49.26.C04.1.454.CMB.1.raw
tcagagtcgagagacacgaccggtgctcgatttagtctagcgactttgggtttgggggctctgggaaaggagccccagcccctgagattcccaggtgtttccattcggtgatcagcactgaacacagaactcaccatggagtttgggctgagcttgggttttccttgttgcttaagttttaaaaggtgtccagtgtgaagtgcagttggtggaatcgtgggggagtcgtggtagagccgtgggggtccctgagactctcctgtgcagcctcgtggattcattctttgattgtattatcgcctatgacacgtggactccgtacaacggtcgtaccgggggaaggtcgtagggaggttcgggtccttcgttacgttttaagtttaaggttggggtagtttgggttagggttacttaccgtaaccctttaacgttacgtcgaccgtaacgtacccttcgttagggtaaggggtaaccgggtttaccggtaactttacccaaccctacttacccgtacccgaacggtaaaccgtaaccgaaaccgaacggaaccgtaaaccgtaaaccccttaccccgtttagttaaccttccgtaacgtaaaccgtaaaacgtaccgtaaacgttacggttaccgtaaccgagggtaacgggtacgggaaccggtaacccgtaaccccgttcccttaccttacccgttacgttacggttaacgaaccggttaaaacggtaaccgttaaccggtaaccgtaacccgtaacccttaacccgtttaacgtttttaaccggaccccgtacgtaccccgggg

SEQ ID NO: 70428 - DNA, 402 bp, Homo sapiens
  misc_feature: GYAE6OF02HFWGY.49.26.C04.1.454.CMB.1.raw
  modified_base (397)..(402): a, c, t, g, unknown or other
  misc_feature (397)..(402): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccagggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgacgcgggctggcaaggccgcatagnnnnnn

SEQ ID NO: 70429 - DNA, 564 bp, Homo sapiens
  misc_feature: GYAE6OF02HNHGQ.49.26.C04.1.454.CMB.1.raw
  modified_base (305)..(305): a, c, t, g, unknown or other
  misc_feature (305)..(305): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctcttttaagaggtgtccattgtcaggtgcagttaatggagtcggggggatctgtggtccggcctgggaggtccctgagactctcctgtgcagcctccggattccaacttcgggaactatggcttacactgggtccnccaggctccaggcaaggggctgggagtgggtggcagtttattcatatgattcaagtatggattatacgcagagtaccgttaagggcctattcacctatcctaccagacgacaattaccaaagaaccacctagtactctagactaattagaacacgactacgagagcgtagagacgacggcttgtgtattattgtgtagaagtacgtttatgtaagtaagttaagttggttttacgagttataggtatagtagttaacgg

SEQ ID NO: 70430 - DNA, 598 bp, Homo sapiens
  misc_feature: GYAE6OF02FUTIC.49.26.C04.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctcgtggattcatctttgatgattatgccatgcactggatccgtcaaggcgtccggggaaggtctggngtggtctctcttattatgggnttggtggtatcactactatncagactntgtggagggtcattcaccatctcgagagacaacagacaacgaacctcctgtatcgtgactaatcgaaactcgtactgaggtaggtcgaacggacctaacccgtacctttcgtaacccttacgtacggttacgaacgtaaaaacggtcgtttaaccgggtaccggtaacccctaccttaaacccgttttacgttttaccgaacccgtacgttacccgggg

SEQ ID NO: 70431 - DNA, 881 bp, Homo sapiens
  misc_feature: GYAE6OF02GKPF4.49.26.C04.1.454.CMB.1.raw
  modified_base (254)..(254): a, c, t, g, unknown or other
  misc_feature (254)..(254): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctggacgcctctatgagctgacacacgccctacccgtcggtgtcggtcgtccccgaggaccaaacggccaggactaacctgctcgtggagatgactattcgaaaccaaaaaaatntacgtcttaggttacggtaaccaaggaaaagtaagtacgaacgggacccgacgggaccccggttggttacggccttcgtaacttcctaagttacggaaccgaacgaaacggaaaaacccggacccccgttaccgggaactccccgtaggaacgtaacgtaactttccgtacggtcggtacccttacccgaaccgttaccggaacggggtaccctaagtccgggacccttacggttacgaaccttacgtacgaccggggccgggtacccgtagggtacgggaggtagtaacgggtaagggttaccgtaacgtttaacgttacgtttacgttaaccgttaccgaacccgtaagtaacccgtaaaccgtaacggttaaacgtaaaactaccgtaaacgaaacgggtaaacggtaaacgttaacgggttacggggtaaccggggaaaccgggtaaaccgtaagggtacccgtaacgggtaaccccgttaccgtaacgggtacgtaacccggaacccggtaaacgggttcccgtacccgggtaacccccccgttcgggttaaccccgtacccgttacccggtttaccccggttaccccccgaaccccgttttccccgtaccccgtttccccg

SEQ ID NO: 70432 - DNA, 409 bp, Homo sapiens
  misc_feature: GYAE6OF02FX7EX.49.26.C04.1.454.CMB.1.raw
  modified_base (395)..(397): a, c, t, g, unknown or other
  misc_feature (395)..(397): n is a, c, g, or t
  modified_base (399)..(409): a, c, t, g, unknown or other
  misc_feature (399)..(409): n is a, c, g, or t
tcagagtcgagagacacgaccggtgctcgatttagtctagcgactttgggtttgggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccagggtggaggatgaaggtgactacgtattgttactcaccagacaccagtgaaaatcacagaggaatattcggcggagggaccaagctgaccgtccgtaggtcagcccaaggctgccccctggtcactctgttccaccctctctcctcgactctgagcggctggcaaggcgcatagnnngnnnnnnnnnnn

SEQ ID NO: 70433 - DNA, 607 bp, Homo sapiens
  misc_feature: GYAE6OF02JS7TT.49.26.C04.1.454.CMB.1.raw
  modified_base (306)..(306): a, c, t, g, unknown or other
  misc_feature (306)..(306): n is a, c, g, or t
  modified_base (475)..(475): a, c, t, g, unknown or other
  misc_feature (475)..(475): n is a, c, g, or t
  modified_base (561)..(561): a, c, t, g, unknown or other
  misc_feature (561)..(561): n is a, c, g, or t
tcagagtcgagagacacgaccggtgctcgatttagtctagcgactttgggtttgggggcgtctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagaggcccgggggtcctgagactctcctgtgcagcctctggattcatctttgatgattatgccatgcactggatccgtnaagcgtaccggggaaggtctgggagtgggtctcttcttagttaagtgggattggtggtatcaccttactatggacagtactcgtgtaggaagggtctattcacctagtccacgagaacgacaaacagacaacgaaacctccgttaagtactctagactaaagtgaaacnggtactacgaaggtacggtagaacggacctacccggtccttactaaccgttacgtagtacgaaacgtaaacgtattaaccgggtanaaccctacctaaccgttatttaaccggaccctacgtcggtacccgg

SEQ ID NO: 70434 - DNA, 645 bp, Homo sapiens
  misc_feature: GYAE6OF02GEGIG.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgttggtaccagaagaagtcaggccaggccccggtgttgctcatctatgacgacagaaaacgccctccggatcccgtagagagattctctggcctccacctcgacgggaccagtcggacctacggttcgaactagtcgacgggccggggacccgagggtgggaaggagtggaaagggtcgaacttaacttagtttacggtttaacctaccgaacccgaacggaaccaaccgtaggttaacgaaaaacttcaaacgaaggtaacggtaaattacgttaccggggacggaacgggaaccgaaagcgtacggtacccgtacgtacggtacgacgtacccgtaacggccgttcccgcccccgttcggtaccaccgttcctccgttccccacccttcctcctcccg

SEQ ID NO: 70435 - DNA, 401 bp, Homo sapiens
  misc_feature: GYAE6OF02GHZ7J.49.26.C04.1.454.CMB.1.raw
  modified_base (388)..(388): a, c, t, g, unknown or other
  misc_feature (388)..(388): n is a, c, g, or t
  modified_base (393)..(401): a, c, t, g, unknown or other
  misc_feature (393)..(401): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctcgccccctggtcactctgtcccacctcctctctctcgactctgagcggctggcaacggcncatgnnnnnnnnn

SEQ ID NO: 70436 - DNA, 662 bp, Homo sapiens
  misc_feature: GYAE6OF02GM93U.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctctggattcatctttgatgtattatgccatgcactggactccgtcaacgccgtaccggggaagggtcgtgggaggtgggtctctcttattagtgggatggtgtatctacctatagtgcagtactcgtggtaggaacgggtctactttaccaacctatccctaccgaagaacgaaaccaaacgacggaccaaacgtaaaccttcccgtagttaactccgtagaactaaaagtcgaaactacgttaccgacgtaagggtacgggtagaaacgggtacccaacccggttccctttactaccgttacgtacggtacgtaaacctaaaaacggttccggttaacggtaccgaacccctaaccgtttaaccctttaagttttacccgaaccctacgtaccgggg

SEQ ID NO: 70437 - DNA, 847 bp, Homo sapiens
  misc_feature: GYAE6OF02GPYB8.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaacggccaggataacctgctctggagatgcattgaaccaaaaaatntgcttgttggtaccagaagaagtcaggccaggccccggtgttgctcatctatgaacgacaacgaaaaccgacccgtaccgggactcccgtagacgagtacttccgtcgtcggtcctccgtaccctacgaacggggacctagtccgggtaccgtaaccgtttcggtaacttacgttaccgacggggacccgggggtaccccgtagggggttacgggaacggggtaagttaacgggtaaacgggttacggtaaccgtttaaacgttaacgttttacggtttaaaccctacccgtaaacccgtaaacgtaaacccgtaacccgtaaacggttaaaccggtaaaaacttaccgaaaaccgtaacgggtaaacggggtaaaacctttaacgggtttaccgggggaaccgggggtaaaccgggggaacccgtaaacgggtaccggtaccggttaaacccggttacccgttaacgggtacccgtaaccggtaccccggtaaaccggggtaccgttaccccggtacccccccggttaccgggttaccccttaaccggtttcccgtttaaccccggtttaccccccttacccctttccccgttcccctttaccccg

SEQ ID NO: 70438 - DNA, 422 bp, Homo sapiens
  misc_feature: GYAE6OF02JO3FH.49.26.C04.1.454.CMB.1.raw
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (408)..(422): a, c, t, g, unknown or other
  misc_feature (408)..(422): n is a, c, g, or t
tcagagtcgagagacacgaccggtgctcgatttagtctagcgactttgggtttggggagatgcattgccaaaaaatatgcttgttggtaccagaagaagtcaggccaggccccggtgttgctcatctatgacgacagaaaacgaccctccgggatccctgagagattctctggctccacctcagggaccatggcccacgttgacctatcagcgggcccaggtggaggatgaggtgactactattgttactcacagacaccagtgaaaatcacagaggaatagttcggcggtaggggaccaaggcgtagaccggtacctggtacacgcccgaaggcctcgccccctggtccactctcgtcccacctcctctcctctcgactctgacgcggctggccaggcgnagtncgnnnnnnnnnnnnnnn

SEQ ID NO: 70439 - DNA, 575 bp, Homo sapiens
  misc_feature: GYAE6OF02G5IN0.49.26.C04.1.454.CMB.1.raw
  modified_base (239)..(239): a, c, t, g, unknown or other
  misc_feature (239)..(239): n is a, c, g, or t
  modified_base (414)..(414): a, c, t, g, unknown or other
  misc_feature (414)..(414): n is a, c, g, or t
  modified_base (454)..(454): a, c, t, g, unknown or other
  misc_feature (454)..(454): n is a, c, g, or t
  modified_base (567)..(567): a, c, t, g, unknown or other
  misc_feature (567)..(567): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgaccaaaaaaatntgcttgttggtaccagaagaagtacaggccagggccccgtgttgctcatctatgacgacagaaaaccgacccgtccgggatcccgtgacagtattctctggctccaccgtcacgggaccagtcggcctacgttagactagtcaggcgggcccgagggtcggaggagtcgaaggtnaacgtatacgttgtactcactagacacagtagaaatcaanagagatacgtggacggtacggacaagcgtagaaccgtctacggacacggacccgaaggtccgaccggtccccgtcgtaccgaccttccggtaccttaccccggtcccttcccnccttcccg

SEQ ID NO: 70440 - DNA, 402 bp, Homo sapiens
  misc_feature: GYAE6OF02IZ6IB.49.26.C04.1.454.CMB.1.raw
  modified_base (398)..(402): a, c, t, g, unknown or other
  misc_feature (398)..(402): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaaatcaacagaggaatattcggcggagggaccaagctgaccgtcctaggtcagcccaaggctgccccctcggtcactctgttcccaccctcctctctctcgactctgagcgggctggcaaggcgcatagnnnnn

SEQ ID NO: 70441 - DNA, 691 bp, Homo sapiens
  misc_feature: GYAE6OF02GSY8V.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaggtgtccagtgtgaagtgcagttggtggatctgggggagtcgtggtagagccgtggggggtccctggagactctcctgtgcagcctctggattcatctttgatgtattatgccatgcacgtggactccgtacaaggccggtaccgggggaagggtcgtagggaggttcggggtccttcgttcgtttacgtttaagtttggggtacttgggttaggttaactccgtaaccttacttagtacgtcaacgtaccgttacgttggtacgggtaacgggttcgtaacgtttccaaccctagtccttacccgaagtacgaacaaacgacgaccaaacgtaaacccttcccgtagttaactccttagaacctaaagttacgaaacgtacgttacctacggaacggtagggtacgaaccgggacctacccggttacccttacttaccgtacgttggtaccgaacgtaaaagtacgtttacggacgaacccaccttaccttagtttaccgacctacgtccgg

SEQ ID NO: 70442 - DNA, 579 bp, Homo sapiens
  misc_feature: GYAE6OF02HDZ3R.49.26.C04.1.454.CMB.1.raw
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcggtggtagagccgtggggggtccctgagactctcctgtgcagcctctggattcatctttgatgattatgccatgcatgatccgtcaagcgtcggggaaggtctggagtggtctctcttatagtggatggtgtatcactactatgacagactntgtaggaagggtcattcacctntcctaccagacgactaaacncgacaacgtaaacctcctagtactctgacaaatcgaaactacgttacgacgaaggtagggtacgaacggaccgtacccgtaccctttacgtaccttacgtgtacgtaaactaaaacggtactttacgggacaaccctaaccg

SEQ ID NO: 70443 - DNA, 414 bp, Homo sapiens
  misc_feature: GYAE6OF02GX08J.49.26.C04.1.454.CMB.1.raw
  modified_base (394)..(414): a, c, t, g, unknown or other
  misc_feature (394)..(414): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgtactcaccagacaccagtgaaaatcacagaggaatattggcggagggaccaaggctgaccgtcctaggtcagcccaaggctggccccctggtcactctgtcccacctcctctctctcgacttctgagcgggctggcaaggcgcatagnnnnnnnnnnnnnnnnnnnnn

SEQ ID NO: 70444 - DNA, 494 bp, Homo sapiens
  misc_feature: GYAE6OF02JJS5A.49.26.C04.1.454.CMB.1.raw
  modified_base (320)..(320): a, c, t, g, unknown or other
  misc_feature (320)..(320): n is a, c, g, or t
  modified_base (459)..(494): a, c, t, g, unknown or other
  misc_feature (459)..(494): n is a, c, g, or t
tcagagtcgagagacacgaccggtgctcgatttagtctagcgactttgggtttgggggagggatgcattgccaaaaaatatgcgttgttggtaccagaagaagtcagggccaggccccggtgttgctcatcctatgacgacaggaaaacgacccctccgggatcccctggagagatttctctcggcctacccacctcaggggacccagttgggcccacggtttcggactactcgaggccgggggtccccagggtcggaggatgaacggtgactactattcgtactcaccagactaccgagtcgaaaatcaacagaggaanattcggacggaggaccaagccgtcgaaccgtcctaaggttcacgccaaggctcggccccttcgggccactccgtcgttcccgccctccgtctcctctccgtactctcgagcggctcggactacggccgctagtacgctnnnnnnnnnnnnnnnnnnnnnnnnnnnnnnnnnnnn

SEQ ID NO: 70445 - DNA, 404 bp, Homo sapiens
  misc_feature: GYAE6OF02I1AW5.49.26.C04.1.454.CMB.1.raw
  modified_base (385)..(385): a, c, t, g, unknown or other
  misc_feature (385)..(385): n is a, c, g, or t
  modified_base (392)..(404): a, c, t, g, unknown or other
  misc_feature (392)..(404): n is a, c, g, or t
tcagagtcgagagacacgaccggtgctcgatttagtctagcgactttgggtttgggggagatgcattgccaaaaaaatatgcttgttggtaccagaagaagtcaggccaggccccggtgttgctcatctatgacgacagaaaacgaccctccgggatccctgagagattctctggctccacctcagggaccatggccagttgactatcagcggggccaggtggagatgaaggtgactactatgttactcaaccagacaccagtgaaaatcacagaggaatattcggcggagggaccaagctgaccgtcctaggtcagcccaaggctgccccctggtcactctgtcccgcctcctctcctctcactctcgagcggctggcaaggcncatacgnnnnnnnnnnnnn

SEQ ID NO: 70446 - DNA, 576 bp, Homo sapiens
  misc_feature: GYAE6OF02GWG13.49.26.C04.1.454.CMB.1.raw
  modified_base (240)..(240): a, c, t, g, unknown or other
  misc_feature (240)..(240): n is a, c, g, or t
  modified_base (363)..(363): a, c, t, g, unknown or other
  misc_feature (363)..(363): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttactggtaccagcagaggccaggccaggcccctgtcttggtgtatttaataaagtactttggagaggccctgacgggacccctggacgcgtattctcgtggctcagctcgaggacaacngtcacttgaccatcagtggacgtccggcaggaggacgaggctgaacttagttactgtcacgtccgacagtacagcaggtcggctagttatgtacgtagttccgggagggtaacggacgtacgtcgtacggacccgttcgtacgggtccaacggcccgaagggtccctccggtccccctagggtccctacctccgtttccgtacccccgtcccc

SEQ ID NO: 70447 - DNA, 604 bp, Homo sapiens
  misc_feature: GYAE6OF02HKY5E.49.26.C04.1.454.CMB.1.raw
  modified_base (242)..(242): a, c, t, g, unknown or other
  misc_feature (242)..(242): n is a, c, g, or t
  modified_base (387)..(387): a, c, t, g, unknown or other
  misc_feature (387)..(387): n is a, c, g, or t
  modified_base (449)..(449): a, c, t, g, unknown or other
  misc_feature (449)..(449): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaaccaaaaaaatntgtcttgttggtaccaagaagaagtcaggccaggccccggtgttgctcatctatgacgaacaagaaaaaccgaccccgtaccgggactccccgtagagtagattctcgtggcctccacctcgagggacctagtcggcctacggtnactatcaggccgggcccgagggtgggagagtggaaggtgaactactattattactcaaccanaccaacgtagaagtaaactcaacagaagaatacggtcgggacggacggaacgactcgtacgtaccgtcgtacggacacgaccgtaacggcctaccggcccccgtggtacctaccgttccttcccgttccccgtaccccttccttccgttaccccg

SEQ ID NO: 70448 - DNA, 527 bp, Homo sapiens
  misc_feature: GYAE6OF02GIETD.49.26.C04.1.454.CMB.1.raw
  modified_base (241)..(241): a, c, t, g, unknown or other
  misc_feature (241)..(241): n is a, c, g, or t
  modified_base (360)..(360): a, c, t, g, unknown or other
  misc_feature (360)..(360): n is a, c, g, or t
  modified_base (512)..(512): a, c, t, g, unknown or other
  misc_feature (512)..(512): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntgcttactggtaccagcagaggccaggccaggcccctgtcttggtgatttataaagtacttttgagaggccctcgagggacccctggagcgattctctggctccagctcagggacaacngtcaccttgaccatcagtggacgtccgcagaggacgaggctgactattactgtcagttccgacagacagcagtgctagttatgttcgtagttcgggacggagggactacgctacgccgtctaggtcacgcccgaagcctcgcccctggtccnctctcgtccctaccc

SEQ ID NO: 70449 - DNA, 774 bp, Homo sapiens
  misc_feature: GYAE6OF02I2QM5.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccacctcggtgtcggtcgtccccaggacaaacggccaggataacctgctctggagatgcattgaaccaaaaaaatntagctttgttcggtaccaagaagaagtcaggccaggccccggtgttgctcatctatgacgacaagaaaccgacccgtacgggactccgtgagagattctctcggctccacctcgacggaccatcggacctacgttgactatcgagggccggggacccgtaggggtacgggagggtacgtagggtaaacgggtacggtaaccgttaacgtttaacgttttacgtttacccttaacccgtaacccgaaacgtaaacccctaaaccggaaacggttaaacgggtaaaaaaactttcccgaaaccggtaaagggaaacggttaaaacgttaacggttttaccggggacggggtaaaccggggaaccgtaaaccggaaccggttaccggtaaacccggttccctttaacggggaccgtaaccggtaaccccggaacggtaacccgtacccgggtaccccccgttcccgggttacccgtacccgttcccgtttcccgtttacccccgtaacccccgttcccctttccctttaccccgg

SEQ ID NO: 70450 - DNA, 682 bp, Homo sapiens
  misc_feature: GYAE6OF02HA5Y7.49.26.C04.1.454.CMB.1.raw
  modified_base (244)..(244): a, c, t, g, unknown or other
  misc_feature (244)..(244): n is a, c, g, or t
  modified_base (419)..(419): a, c, t, g, unknown or other
  misc_feature (419)..(419): n is a, c, g, or t
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggcctcctatgagctgacacagccaccctcggtgtcggtgtccccaggacaaacggccaggataacctgctctggagatgcattagaaccaaaaaaatntgctttgtaggtaccaagaagaagtcaaggccaacggccccggtgttcgctactatctatcgaacacgaaacgaaaaccggtaccccgtaccgggactccccgtaggaacgaagtactttcgtcttacggcctaccgaccgtacgaacgggaccagtcggacctacgttgactancgacggccggggccagggtagggaggactaggaaggtagtacgtacgttagttacgttacacaacccgagaaccaactagtaagaaactacgagaaggagtaaatacggttacggacgggaacggaacaacgcgtcgaacccggttacctacggtacaaccggacccgaacgggtcccttacccgggacccccgttccggtaaccgtacccgttccgtttacccggttaccccccttacccccgttacccttccttaccccgg

SEQ ID NO: 70451 - DNA, 571 bp, Homo sapiens
  misc_feature: GYAE6OF02F8KA7.49.26.C04.1.454.CMB.1.raw
  modified_base (404)..(404): a, c, t, g, unknown or other
  misc_feature (404)..(404): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaagcaatatgcttactggtaccagcagaagccaggccacggcccctgtcttgatctatttataaagtacttgagagggcctcgacgggacccctgacgcgtattctcgtggctccgagctcgacgcgaacaacgacgtacacgttcgacctatcgaggtggacgtccgggnaggaggacgagctagactagttcgtgtcagtcagtcagatagtagtggctacttctcgttacgtacgttcgggacggtacggaccaaggtcgtacggtacccgttccgtacggtccaacggacccgaacggtcccgtacccggtcccccgttcggtacccttacccg

SEQ ID NO: 70452 - DNA, 499 bp, Homo sapiens
  misc_feature: GYAE6OF02F5OT8.49.26.C04.1.454.CMB.1.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (435)..(435): a, c, t, g, unknown or other
  misc_feature (435)..(435): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(446): a, c, t, g, unknown or other
  misc_feature (445)..(446): n is a, c, g, or t
  modified_base (451)..(453): a, c, t, g, unknown or other
  misc_feature (451)..(453): n is a, c, g, or t
  modified_base (455)..(457): a, c, t, g, unknown or other
  misc_feature (455)..(457): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (466)..(467): a, c, t, g, unknown or other
  misc_feature (466)..(467): n is a, c, g, or t
  modified_base (469)..(469): a, c, t, g, unknown or other
  misc_feature (469)..(469): n is a, c, g, or t
  modified_base (471)..(477): a, c, t, g, unknown or other
  misc_feature (471)..(477): n is a, c, g, or t
  modified_base (479)..(487): a, c, t, g, unknown or other
  misc_feature (479)..(487): n is a, c, g, or t
  modified_base (489)..(499): a, c, t, g, unknown or other
  misc_feature (489)..(499): n is a, c, g, or t
tcagagtcgagagacacgaccggtgctcgatttagtctagcgactttgggtttggggaggatgcattgccaaaaaatatgcttgttggtaccagaagaagtcaggccaggccccggtgttgctcatctatgacgacagaaaacgaccctcgggatccctgagagattctctggcctccacctcagggaccatcggccaacgttgactatcagcggggcccaggtggagatggaaggtgacctatattntacgtcacagacnccagtagaaatcanagagaatagtcgaggaggtacaagcgtgaccgtccaggtacacgcccgaagctcggccccctgggtctaccgtctcggtttaccccacccgttcctacctcttccctacgaccttcgtcgacggtcggacctcggaccgaacggtcggacccagttacgntacgncgncnncgacnnncnnnacncncncnncncnnnnnnncnnnnnnnnncnnnnnnnnnnn

SEQ ID NO: 70453 - DNA, 823 bp, Homo sapiens
  misc_feature: GYAE6OF02FFQHJ.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctcccctctcactttctgcacagtctctgaggcctcctatgagctgacacagccaccctcggtgtcggtcgtccccaggacaaacggccaggataacctgctcgtggagatgctattgaccaaaaaatntgcttgttggtaccagaagagtcaggccaggccccggttgtcgctcatctatgacgacagaaaaccgccgtccggactcccgtgaacgagtactttcgtacgtcggtacctccgacctcgacgggtacccagttcggacctacggttacgacctacgtaccgaacgggcccgggggtaccccgaaggggtcgggaacggggtaacgttacgggtaaacgggttcgtaaacccgtttaaacgtttacgtttaccggttttaacccgtacccgtaaacccgtaaccgaacccgtaacccgtaaaggttaaacggtaaaacttaccgaaccgtaaagggttaacggtaaacgtttaacgggtttaccgggggaaccggggttaaccggggaaacccgtaaacgggaccgttaaccgggtaccccggttacccgttaacgggttacccgaaccgggaccccgtaaacggggtcccgttaccccgggtacccccccgtttaccggggtaccccttaacccgtttccccggtttaccccgtttacccccccgtacccccgtttccccgtttaccccgttttacccccg

SEQ ID NO: 70454 - DNA, 415 bp, Homo sapiens
  misc_feature: GYAE6OF02F777R.49.26.C04.1.454.CMB.1.raw
  modified_base (401)..(415): a, c, t, g, unknown or other
  misc_feature (401)..(415): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgacccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctcgccccctcggtcactctcttcccaccctcctctctctcgactctgacgcgggctgggcaagggcgcatagnnnnnnnnnnnnnnn

SEQ ID NO: 70455 - DNA, 532 bp, Homo sapiens
  misc_feature: GYAE6OF02FR9RI.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaaatntgcttgttggtaccagaagaagtcaggccaggccccgtgttgctcatctatgacgacagaaaacgccctccgggatcccctgagagattctctggctccacctcagggaccatggccacgttgactatcagcggggcccagggtggagagtgaaggtgactactattgttactcaaccagacaccagtagaaaatcaacagaaggaatagttcggacggaggaccaagctagaccgtcaggtcagccgaaggctcgcccctcggtcactctcgtccccgccctcctctcc

SEQ ID NO: 70456 - DNA, 735 bp, Homo sapiens
  misc_feature: GYAE6OF02IN3XI.49.26.C04.1.454.CMB.1.raw
  modified_base (226)..(226): a, c, t, g, unknown or other
  misc_feature (226)..(226): n is a, c, g, or t
  modified_base (361)..(361): a, c, t, g, unknown or other
  misc_feature (361)..(361): n is a, c, g, or t
  modified_base (618)..(618): a, c, t, g, unknown or other
  misc_feature (618)..(618): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacacgccaccctcggtgtcggtcgtccccaggacaaaccggccaggactaacctgctcgtggganatcgctattcgaaaccaaaaaatcgtgtagttcggttacggtaccaaggaagagtacgacggccgacgggtccccggtgttcgcttagacttcgatacggaacacgaaacgaaaaccgtccgtaccggactccgngagtactacgttactgtacgcctacctaccgtcgacgggacctaggtcccgacggtagttacgactagtacgccggtcgggacccgtagggtacggacggtagtacggagtatacgtacttagttacgtactaccgaacacgacgtaacgtacgtaaagaacgttaccaagtacggaagtaacttacgggtacgggtacggaaacccggggactaaccggtcgttaacccgggaacccgtacggttaaaccggggtntaaacccggcccggtaacggttacccgaccccggttcccccggtagggttaacccctttcccgtaccgtttccccggtttaccccgtccccgtttacccgtccccggttaaccccgg

SEQ ID NO: 70457 - DNA, 403 bp, Homo sapiens
  misc_feature: GYAE6OF02FW14J.49.26.C04.1.454.CMB.1.raw
  modified_base (379)..(379): a, c, t, g, unknown or other
  misc_feature (379)..(379): n is a, c, g, or t
  modified_base (396)..(403): a, c, t, g, unknown or other
  misc_feature (396)..(403): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctcgttcccaccctcctctctctcgactctgagcggntggcaaggcgacatagnnnnnnnn

SEQ ID NO: 70458 - DNA, 424 bp, Homo sapiens
  misc_feature: GYAE6OF02G4B4Y.49.26.C04.1.454.CMB.1.raw
  modified_base (346)..(346): a, c, t, g, unknown or other
  misc_feature (346)..(346): n is a, c, g, or t
  modified_base (402)..(424): a, c, t, g, unknown or other
  misc_feature (402)..(424): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatcccctgagagattctctggctccacctcagggaccatggccacgttgactatcagcggggcccaggtggaggatgaaggtgactactattgttactcaccagaccaccagtagaaaatcacagaggaatagttcggcggagggaccaagctagaccgtcctaggtcacgccaaggctcgccccctggtcnctctcgtcccacctcctcttctctcgactctgacgcgggctggcaaggcgcatagnnnnnnnnnnnnnnnnnnnnnnn

SEQ ID NO: 70459 - DNA, 739 bp, Homo sapiens
  misc_feature: GYAE6OF02GOE9F.49.26.C04.1.454.CMB.1.raw
  modified_base (239)..(239): a, c, t, g, unknown or other
  misc_feature (239)..(239): n is a, c, g, or t
  modified_base (337)..(337): a, c, t, g, unknown or other
  misc_feature (337)..(337): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgtgtaccagaagagtcaggccaggccccgtgtgctcatctatgacgacaagaaaaccgcccgtaccgggactccctggagagtacttcgttcnggtcctccacctcgacgggaccacgtcggcctacgttcgacttactcgacgggtccggggcccgtagggtcggaggtacgtagggtaagggtacgaaccgttaacttagtttcgtttaacctaccgtaaccacgtaaccaaccgtaagttaagaaaactccgaacgtaagggaacgtaacgttaaggtttacggggaccgggtaacggggaacccgaaaggtccgtacggtaaccccgtttaccggtaacgggttacccgaccggtaaccccggtaacgggtccccgtttaccccgggtccccccggttacccgggtaacccctttacccggtttacccgttttaccccggttaccccccccgtttaccccccgtttaccccctttcccccgtttacccccg

SEQ ID NO: 70460 - DNA, 403 bp, Homo sapiens
  misc_feature: GYAE6OF02G7RMM.49.26.C04.1.454.CMB.1.raw
  modified_base (300)..(300): a, c, t, g, unknown or other
  misc_feature (300)..(300): n is a, c, g, or t
  modified_base (399)..(403): a, c, t, g, unknown or other
  misc_feature (399)..(403): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacacagtgaaaatcacagagaatattcggcggagggaccagcngtaccgtcctaggtcacgcccaaggcctcgccccctcggtcactctcgttcccgccctctctctcctcgactctgacgcgggctggcaaggcgcatagnnnnn

SEQ ID NO: 70461 - DNA, 579 bp, Homo sapiens
  misc_feature: GYAE6OF02FQUCS.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccggtcaaggcgtaccgggggaagggttctgggagtgggtctctcttattaagttgggatggtggtatctacctactatgcagactctgtgaagggtcattcaccatcctccagacgacaacagaccaagaaaccttcctagtatctagacaaagtgaacagtctacgaaggtagggtagaacggaccacccgtcccttctacttacgtgtagaaccaaaagtacgttaacggtacgaaccctacctaacctttagttttaccgacctacgtaccggg

SEQ ID NO: 70462 - DNA, 731 bp, Homo sapiens
  misc_feature: GYAE6OF02JJ4KY.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgctattgaccaaaaaaatntgcttgttcggtaccagaagaagtcaggccaggccccggtgttcgctcatctatgacgacaacgaaaccgacccgtacgggactccgtgacgagtacttcctcgtcggcctccgacctcgaacgggacctagtcggacctacggttcgaactactcgacgggccgggacccgagggtcgggaggtacgaggtaacgggtcgtaacgttacgttacgtttacggttacctaccgaaccgtacgaaccgtaaccgtaaggttaaacgtaaaaccttacgaacgtaacgggaagggttaaacgttacggttaccggggacgggtaaaccgggaacccgaaggtaccgtacggtaacccggttacgtaacgggtacccgacggacccggtaaacgggtcccgttacccgggtacccccgttacgggttacccgtaacccgtttcccgtttacccggttacccccctaccccggtttcccttacccggttcccc

SEQ ID NO: 70463 - DNA, 666 bp, Homo sapiens
  misc_feature: GYAE6OF02ID00F.49.26.C04.1.454.CMB.1.raw
  modified_base (165)..(165): a, c, t, g, unknown or other
  misc_feature (165)..(165): n is a, c, g, or t
  modified_base (189)..(189): a, c, t, g, unknown or other
  misc_feature (189)..(189): n is a, c, g, or t
  modified_base (593)..(593): a, c, t, g, unknown or other
  misc_feature (593)..(593): n is a, c, g, or t
  modified_base (596)..(596): a, c, t, g, unknown or other
  misc_feature (596)..(596): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (643)..(644): a, c, t, g, unknown or other
  misc_feature (643)..(644): n is a, c, g, or t
  modified_base (646)..(650): a, c, t, g, unknown or other
  misc_feature (646)..(650): n is a, c, g, or t
  modified_base (652)..(665): a, c, t, g, unknown or other
  misc_feature (652)..(665): n is a, c, g, or t
tcagagtcgagagacacgaccggtgctcgatttagtctagcgactttgggtttggggagatgcattgcaaaaaaatatgcttgttggtaccagaagaagtcaggcaggcccggtgttgctcatctatgacacagaaaacgccctcgggactccctgagagattcnctggcttccacctcgacgggaccngtcggccacggttgacttactcgaggccggggcccagggtggacggattggaagggttcaacttactaagtttcggtaactccgaccaggaccaacaagttacgaaaaactcaacgaagacggtaaatacgttacgggacggaaacgggtaaccaaggaccgtacggaaccgttaccgtaacgggtaccaacggaccctaaaggggtcccgtaccggacccccccgtttaggggtacccttaaccggtttccgttaccccgggtttacccctaccccccggttacctttaccccgtttacccttaccccggtttacccggtaacttcccggtttacgggaaccgggtccggggtccgtaacgtacccggaaacgggtcccgataccgggtagtccgacgcgtancgngactcgaacncgtntcncngcgcncncncncngcncgngcncngngnncnnnnncnnnnnnnnnnnnnnc

SEQ ID NO: 70464 - DNA, 553 bp, Homo sapiens
  misc_feature: GYAE6OF02JGO7I.49.26.C04.1.454.CMB.1.raw
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatctgggggagtcgtggtagagcctggggggtccctgagactctcctgtgcagcctctggattcatctttgatgattatgccatgcactggatccgtcaagctccggggaaggtctggagtgggtctctcttattaattgggatggtggtatcacctatatgcagactctgtgaagggtcgattcacatcnccaganacaacngcagaaacctccctagtactctagacaaagttagaaactgttactcgaggtaggttgaaggacctacccgtccttctaccttactggttcaactaaaacgtgtttacggtacgacctaacc

SEQ ID NO: 70465 - DNA, 794 bp, Homo sapiens
  misc_feature: GYAE6OF02FPUN5.49.26.C04.1.454.CMB.1.raw
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctggacggcctcctatgagctgacacacgcccacccgtcggtggtcggtcgtccccgaggacaaacggccaggactaaccngctcgtggagatgctattcgaaaccaaaaaaattntgtctttaggttcggtaaccaaggaaagaacgtacgacggaccgacgggccccggttgttgccgtacactctatacgaccgacaaacggaaaaccgacccgtaccggtactcccgtagagagtacttctcgtcggtcctaccgtacctcgacggggaccaggtcgaccgtacgttacgtaactagtacgacggcccggggaccctaaggggtagggaacgggtacgttaagggaacgggtttacggaaacctttaaacggtttaagtttacggtttaacccttaccgaacccgtaaccgaaccgtaaaccgtaggtaaacgtaaaactaccgaaacgtaagggaaaggtaacgttaacgggtaccgggacgggggaacggtaaccgaaggtaccgtaaccgtacccggttaaccggtacgggttaccgaaccgacccggtaacggtacccggtccccggtaccccccgttacggtacctaccccgttccggttaccccgttaccccccgtaacccctttcccgtacccgtttaccccg

SEQ ID NO: 70466 - DNA, 560 bp, Homo sapiens
  misc_feature: GYAE6OF02IL1GQ.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctatggagatgcattgaccaaaaaaaatntagcttgttggtaccagaagaagtcaggccaggccccggtgttgctcatctatgacgacagaaaaacgaccctccgggatccctgagagattctctggctccacctcagggaccatggccacgttgactatcagcggggcccagggtcggaggatgaaggtgactactattgtactcaccagacaccagtagaaatcacagaggaatagttcggaggacgggaccaagcgtagaccgtactaggtcagcccaaaggtcctacggccccctcggtaccctacgtccgttccggttccccgccccttcccgtccttcccg

SEQ ID NO: 70467 - DNA, 396 bp, Homo sapiens
  misc_feature: GYAE6OF02FXKPE.49.26.C04.1.454.CMB.1.raw
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (394)..(396): a, c, t, g, unknown or other
  misc_feature (394)..(396): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctcgccccctggtcactctgttcccacctcctctctctcgactctgagcggctggcaaggcncanagnnn

SEQ ID NO: 70468 - DNA, 406 bp, Homo sapiens
  misc_feature: GYAE6OF02I4V3B.49.26.C04.1.454.CMB.1.raw
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (388)..(388): a, c, t, g, unknown or other
  misc_feature (388)..(388): n is a, c, g, or t
  modified_base (393)..(406): a, c, t, g, unknown or other
  misc_feature (393)..(406): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcgggcccaggtggaggatggaaggtgactactagttgtactcaaccagacaccagtagaaaatcacagagaatagtcggcggaggacagctgaccgtcaggtcacgcccaaggctcgcccctgcnctctctcccncctctctctctcgtactcgtgacgcggtctggaccacgggcncatgnnnnnnnnnnnnnn

SEQ ID NO: 70469 - DNA, 749 bp, Homo sapiens
  misc_feature: GYAE6OF02IIPL5.49.26.C04.1.454.CMB.1.raw
tcagagtcgagagacacgaccggtgctcgatttagtctagcgactttgggtttggggtgggctcaggtaggcagagcttctgggaatctcaccatggcctggacccctctcctgctcccccgtcctcactttctcgcgaccagtctctcgaggcctcctatgagctgacacagccaccctcggtcgttcggtcgtcccaggaacaaacggccaggataacctgctcgtggagactgacagttacgaaccaaaaaaattgtcgtactttggttaggtaaccaagtaaagaagtcgaagggaccctaacgggtccccggttgttcgcctcaagttactacgttagaccgacaaacggaaaaccgtaccccgtacgggacctaccccgtaggaacgagtaccttctctacggtcctacccgaacctcggaacggacctacgtcggaccctaggttacgaacgtactacgacgggtcccggggtaccgtagggtcgggaaggtacggtaggtaaggttacggtaacgttaacgttatttacgtactaccacgtagtaccaacggtaagtacggaaactaccgaacgtaaggaacggtaacgttagggttaccgggacgggtaacgggaaccgacggtaccgtacggtaccgttaccgtacggtaccgaccggacccgaacggtccgtacccggtccccgttacccgtccgtacctccgttaccctaccccgtacccttcccttaccttacccg

SEQ ID NO: 70470 - DNA, 699 bp, Homo sapiens
  misc_feature: GYAE6OF02G03XC.49.26.C04.1.454.CMB.1.raw
  modified_base (289)..(289): a, c, t, g, unknown or other
  misc_feature (289)..(289): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctcctgtgcagcctctggattcattctttgatgattangccatgcacgtggactccgtacaagccgtaccgggggaacggtcgtagggtaggttcggggtctcgttctttagttaagttgggtaagttgggttagttactacctaaccttacttagtcgacagtaaccttcgttaggtacggtaacgggtacgtactttaccgaccgtacttccctaccgaaggtaacgaaccaaacgacgaacccgaagtaaacccttcccgttagtaccttcgtagacctaaaagtcgaaacgtacgtacctacgaagggtcggtagaaccgggtaccctacccgtacctttccgtaacttacgttcggtaacggaacctaaaacggttcgttaaccggtaccgaacccttaacgttaacccgtttacgtttaccggtaaccctcggtaacccggg

SEQ ID NO: 70471 - DNA, 402 bp, Homo sapiens
  misc_feature: GYAE6OF02HDCZ3.49.26.C04.1.454.CMB.1.raw
  modified_base (330)..(330): a, c, t, g, unknown or other
  misc_feature (330)..(330): n is a, c, g, or t
  modified_base (390)..(390): a, c, t, g, unknown or other
  misc_feature (390)..(390): n is a, c, g, or t
  modified_base (393)..(402): a, c, t, g, unknown or other
  misc_feature (393)..(402): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgacccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgacccgtcctaggtcagcccaaggcncgccccctcggtcactcctcgtcccaccctctctctctcgactctgcgcggctgcaggcncannnnnnnnnn

SEQ ID NO: 70472 - DNA, 398 bp, Homo sapiens
  misc_feature: GYAE6OF02I08IX.49.26.C04.1.454.CMB.1.raw
  modified_base (394)..(398): a, c, t, g, unknown or other
  misc_feature (394)..(398): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccaccctctctctctcgactctgagcgggctggcaaggcgcatagnnnnn

SEQ ID NO: 70473 - DNA, 802 bp, Homo sapiens
  misc_feature: GYAE6OF02IYDF9.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatntagcttggttggtaaccagaagaagtcaggccaggccccggtgttgctcatctatgaacgacaagaaaaccgaccctccgggactccctagagagattctcgtggcctccacctacacgggaccagtcggcctacggttcgaactacgtcgacgggccggggcccgtaggggtagggaacggaagttacgggaagggttacggtaaccttaacgtttaacgttttacggtttaaccttaccgaaccctaaacggtaaccaaacccgttaagggttaaacgtaaaaaacgttccaaacgtaaagggaaacgggtaaaccgtttaacgggtttaaccggggaaccggggggtaaaccggggtaaacccgtaaacgggttaccgttaaccgggtaaaccccgggtttaccgttaaccggggttaccgaaaccggttaccccggaaacggggttccccgttacccgggtaccccccccgttacgggtttaccccgtaacccgttttacccgtttacccgtttaccccccctaacccccgtttacccctttacccggtttaccccc

SEQ ID NO: 70474 - DNA, 589 bp, Homo sapiens
  misc_feature: GYAE6OF02H6UVA.49.26.C04.1.454.CMB.1.raw
  modified_base (343)..(343): a, c, t, g, unknown or other
  misc_feature (343)..(343): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctatttaaaggtgtccagtgtgagtgcagttggtggaatcgtgggggagtcgtggtagagccgtggggggtccctgagctctcctgtgcagcctctggattcattctttgatgattatgccatgctactggactccgtacaagccggtccggggaaggtctgggaggttggtctntcttaatagtggatggtagtatcactactatcgcacgtactgtggtaggagggtctattaccacctactcctaccgagacgaacgaacagacaacgtaaaccttcctagtatctagacaaagtgaactagtcagaggacggtagacggacctacccgtaccttactactacgtcgataaccgaaagtcgtttaaccggacctaaccctaccgtaacctttagttttaccgacccttagtacccggg

SEQ ID NO: 70475 - DNA, 678 bp, Homo sapiens
  misc_feature: GYAE6OF02G9GI2.49.26.C04.1.454.CMB.1.raw
tcagagtcgagagacacgaccggtgctcgatttagtctagcgactttgggtttgggggcgtctgggaaaggagccccagccctgagattcccaggtgtttccattcggtgatcagcactgaacacagaactcaccatggagtttgggctgagctgggttttccttgttgctattttaaaggtgtccagtgtgaagtgcagttggtggaatcgtgggggagtcggtggtagagccgtggggggtccctgagactctcctgtgcagcctctggattcattcttgatgatttagtcgcctatgctacgtggactccgtacaacgtccgtaccggggaaggtcgtggaggttcgggtctcttcgtttaattaagttggggtacttggtgggttatccgtaaccgttatagttcgactacgtacttcgtggtacggaacgggggtctaacgtttacccaaccgtaacttccgtacccgaaggtaacgaaaccgtaaacgacgacgaaacgtaaacccttcccgtagttactctacgacaaagtacgaacgtacgttacctacgtaaggacggttacgggacgtaacccgacccgtccttaccgtaccttacgtcggtactaaacgtaaaagtcgttaaccggtacgacctaacctacgtttacgtttacgaccctacgtcggg

SEQ ID NO: 70476 - DNA, 678 bp, Homo sapiens
  misc_feature: GYAE6OF02I54A1.49.26.C04.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (514)..(514): a, c, t, g, unknown or other
  misc_feature (514)..(514): n is a, c, g, or t
tcagagtcgagagacacgaccggtgctcgatttagtctagcgactttgggtttggggtgggctcaggaggcagagctctgggaatctcaccatggcctggacccctctcctgcctcccctcctcactttctgcacagtctctgacggcctcctatgagctgacacacgccacccgtcggtgtcggtcgccccaggacaaacggccaggactaacctgctgtggagatgcattanaaccaaaaaaatntgtcttgttacggaacagaaagaagtcaacggccacggtcccgtgttgctcatctaagtcgaacgaacacgaaaaccgcccgtaccggactccgagacgagtattcgtcgtacgctaccgacgtacgaacggacctaagtcggtacctacggttacaacgtacgtcgaacgggccgggaccgagggtagggaagtagtacggtaaggagttaactacgttagttacgtactaacgaacgtaacgaacacgtaagaaacgtaaacganaaacgaggtaacgaacgtttacggacggaccggaaggaaccgtaacgcgttaaaccgaccgttaccgaggacccaaggtaacccggtaaccgccgtcccggtacccccttagtaacccgtacgttcccggttacccgtaacccctccccgtttctacccttccg

SEQ ID NO: 70477 - DNA, 738 bp, Homo sapiens
  misc_feature: GYAE6OF02FNI08.49.26.C04.1.454.CMB.1.raw
  modified_base (241)..(241): a, c, t, g, unknown or other
  misc_feature (241)..(241): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaaccaaaaaatntgcttgttggtaccagaagaagtcaggccaggccccggttagttcgctcatctatgacgacaagaaaaccgaccccgtaccggactcccgtagacgagtacttctcgtcggcctaccacctcgacggactacgtcggacctacggttacgtactacgtacgacgggtcccggggacccgtaggggtacgggaacggtagtagggtaacgggtacgtaactaacgtttagtttacgttaacctaccgaaccgacgaaccgaaccgtaagtaaacgtaaaccgttaccaaacgaacgggtaaacgtaaagtttacgggttaccggggaacggggtaacgggaaccgaaacgggtcgtaccgggtaacccggttaccgtaacgggtaccgaaccggaccccggtaagggtacccgtccccggttaaccccccgtggttaccctaccgtttaccccgttccccggttaccccctaccccgttccccttccgtttacccccg

SEQ ID NO: 70478 - DNA, 401 bp, Homo sapiens
  misc_feature: GYAE6OF02GW7EH.49.26.C04.1.454.CMB.1.raw
  modified_base (386)..(386): a, c, t, g, unknown or other
  misc_feature (386)..(386): n is a, c, g, or t
  modified_base (393)..(401): a, c, t, g, unknown or other
  misc_feature (393)..(401): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgtactcaccagacaccagtgaaaatcacagaggaatattcggcggaggaccaagctgaccgtcctaggtcagcccaaggctcgcccctggtcactctcgtcccgccctcctctctctcgactctgagcggtctggcaggcncagtagnnnnnnnnn

SEQ ID NO: 70479 - DNA, 703 bp, Homo sapiens
  misc_feature: GYAE6OF02HL0RY.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtgggggtccctgagactctcctgtgcagcctcgtggattcatctttgatgtattatgccatgcactggacctcgtaagcgtccgggacgggtcgtgtaggtggtcgtcttcgttattaagttaggtagtggtggttagtctacgtactagtagcgacgtactctgtaggtaacggtacgtacgttctaaccacgttcctaccgagtaacgaaacgaaccaagtaccgaaacgtaaacgtacccttacgttaagtacgtacgtacaaagtacaacgtaaccgttactaccgtagggtaacggttaacggacggtaaaccccggtaaccttacccgtttaccctaagttacccgttagggtacgtaaccggaaaaaccgttaagttaacccggggttaacccgtaaccgtaaacccttacccgtttaaccgtttttaaccggacccctaaggtttaccggaacccccgggg

SEQ ID NO: 70480 - DNA, 459 bp, Homo sapiens
  misc_feature: GYAE6OF02GV8WC.49.26.C04.1.454.CMB.1.raw
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (377)..(377): a, c, t, g, unknown or other
  misc_feature (377)..(377): n is a, c, g, or t
  modified_base (418)..(459): a, c, t, g, unknown or other
  misc_feature (418)..(459): n is a, c, g, or t
tcagagtcgagagacacgaccggtgctcgatttagtctagcgactttggggtttgggggagatgcattgccaaaaaaaatatgcttgttggtaccagaagaagtcaggccaggccccggtgttgctcatctatgacgacagaaaacgaccctccgggatccctgagagattctctggctccacctcgagggaccntggccaggttgactatcgacggccggggcccagggtggaggatggaaggtgactagtattcgttactcaccagcacgtagtacgaaatccanaggagaatgttacggacggacggaccgagtccgtggaaccgtcgtaggacacggcccaaggcctacggccctggtcacgtcgtcgtcccnctcgtctcgtcctcactcgagcgtcgcaggcagcgcagtgnnnnnnnnnnnnnnnnnnnnnnnnnnnnnnnnnnnnnnnnnn

SEQ ID NO: 70481 - DNA, 510 bp, Homo sapiens
  misc_feature: GYAE6OF02FS2DB.49.26.C04.1.454.CMB.1.raw
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
  modified_base (444)..(449): a, c, t, g, unknown or other
  misc_feature (444)..(449): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (455)..(456): a, c, t, g, unknown or other
  misc_feature (455)..(456): n is a, c, g, or t
  modified_base (458)..(461): a, c, t, g, unknown or other
  misc_feature (458)..(461): n is a, c, g, or t
  modified_base (463)..(463): a, c, t, g, unknown or other
  misc_feature (463)..(463): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (473)..(474): a, c, t, g, unknown or other
  misc_feature (473)..(474): n is a, c, g, or t
  modified_base (476)..(476): a, c, t, g, unknown or other
  misc_feature (476)..(476): n is a, c, g, or t
  modified_base (478)..(479): a, c, t, g, unknown or other
  misc_feature (478)..(479): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (502)..(506): a, c, t, g, unknown or other
  misc_feature (502)..(506): n is a, c, g, or t
  modified_base (508)..(509): a, c, t, g, unknown or other
  misc_feature (508)..(509): n is a, c, g, or t
tcagagtcgagagacacgaccggtgctcgatttagtctagcgactttgggttttgggggtaggatgcacttgccaaaaaaatatgcttgttggtaccagaagaaggtcgacggccaggccccgggtgtttgcgtcatctatgacgacagaaaacgacccctccgggatccctgagagattctctggctccacctcagggaccatcggccacgttgactatcagcggggcccaggtggaggatgaaggtgactacgtagttgttaactcaccagacaccagtgaaaatctacagtaggaatattcggcgaaggggaaccaaggctgacccgtccgtaaggtcacggtcccaaaggctggcccccctcggtcacctctcgtttcccgccctccgtcgtcctctcgactctgagcgggntcggctaaggcgacgagtacgntgactnnnnnncncncnncnnnntntntntatatnntnanntncacngncngnagagagagagnnnnngnnc

SEQ ID NO: 70482 - DNA, 426 bp, Homo sapiens
  misc_feature: GYAE6OF02H9J0H.49.26.C04.1.454.CMB.1.raw
  modified_base (328)..(328): a, c, t, g, unknown or other
  misc_feature (328)..(328): n is a, c, g, or t
  modified_base (410)..(426): a, c, t, g, unknown or other
  misc_feature (410)..(426): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcaggcggggcccaggtggaggatgaaggtgactactattgtactcaccagacacagtgaaaatcacagaggaatatcggcggagggaccagctagaccgtcctaggtcacgaccaaggccncgcccccttggtccactcttccgtcccaccctcctcctctctcgactctgacgcggtctggacgaggtccgactacgtagcnnnnnnnnnnnnnnnnn

SEQ ID NO: 70483 - DNA, 674 bp, Homo sapiens
  misc_feature: GYAE6OF02G5XB0.49.26.C04.1.454.CMB.1.raw
  modified_base (243)..(243): a, c, t, g, unknown or other
  misc_feature (243)..(243): n is a, c, g, or t
  modified_base (330)..(330): a, c, t, g, unknown or other
  misc_feature (330)..(330): n is a, c, g, or t
  modified_base (366)..(366): a, c, t, g, unknown or other
  misc_feature (366)..(366): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagcccaccctcggtgtcggtgtccccaggacaaacggccaggataacctgctctggagatgcattgaaccaaaaaaatntgcttgttcggtaccagaagaagtcaggccgaggccccggtgtgctcatctatgacgacaacgaaaacgcccgtccgggactcccgngagagattcgtcgtggcctccacctcgacgggaccngtcggccacgttgaacttagtcgaaggccggggacccgagggtcgggaagggtagtacggtaagggtacgtaacgttacgttagtttcgttaccgtacgacccgacgtaaccaaccgtaggtaactaaaactccgaaacgaggtaaacgtaaagttacggttacgggacgggaaacgggaacgtaacgggctacggaacccgttccgtaacggtaccacggtacccggaacggcccttccggtccccccgtacggttcccgtaccttcccgttccgttaccccccgcccctttaccgtcccttacccg

SEQ ID NO: 70484 - DNA, 668 bp, Homo sapiens
  misc_feature: GYAE6OF02IUKTE.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcgggtgtccccaggacaaacggccaggataacctgctctggagatgcattgaaccaaaaaatntgcttgttggtaccagaagaagtcgaggccacggccccggtgttgctcgatctagtgacgacaacgaaaaccgcccgtaccgggactcccgtggagagtacttctcgtggcctccacctcgacgggaccagtcggacctacgttgactagtcgacggccggggccctagggtcgggaaggagtggaaaggtcgaacttacttagttcgttaacctaccaacccgagaaccaccgtaagtaacgaaaactcgaaacaaggaaggtaaattacggttaccggggacggaacgggaaccaaaggtccgtacggaacccgttccgttaacgggtccaaccggtacccgaaggtccgtcccggtacccccggttcggtaccctaccgttcccggttacccgttaccccctaccctttccctcccgttcccg

SEQ ID NO: 70485 - DNA, 435 bp, Homo sapiens
  misc_feature: GYAE6OF02G4BX1.49.26.C04.1.454.CMB.1.raw
  modified_base (420)..(435): a, c, t, g, unknown or other
  misc_feature (420)..(435): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgccctccgggatccctgagagattctctggctccacctcagggaccatggccacgttgactatcaggccggggcccagggtggaggatggaaggtgactactattgttacctcaccagacaccagtagaaaatcaacagaggaatagttcggacggaggaccaagctcgacccgtcctaggtcacgacccgaggcctcgcccccgtcggtccacttcctcgttcccctacctcctcctctctcgactctgacgcgggcgtcgcgaacggcacagtgnnnnnnnnnnnnnnnn

SEQ ID NO: 70486 - DNA, 554 bp, Homo sapiens
  misc_feature: GYAE6OF02IU01L.49.26.C04.1.454.CMB.1.raw
  modified_base (438)..(438): a, c, t, g, unknown or other
  misc_feature (438)..(438): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaaatatgcttgttggtaccagaagaagtcaggccaggcccccggtgttgctcatctatgacgacagaaaaacgacccctccggggatccccgtgagagattctctggctccacctcagggaccatggccacgttgactatcagcggggcccagggtggaggatggaaggtgactactattgtactcaccagacaccagtanaaaatcacagaggaatagttcggacggagggaccaagcgtacgaccgtccgtagggtcagacccgaaggcctcggcccctcggtccactccgtcgttccccacccgttcctctccc

SEQ ID NO: 70487 - DNA, 662 bp, Homo sapiens
  misc_feature: GYAE6OF02JH59P.49.26.C04.1.454.CMB.1.raw
  modified_base (367)..(367): a, c, t, g, unknown or other
  misc_feature (367)..(367): n is a, c, g, or t
  modified_base (448)..(448): a, c, t, g, unknown or other
  misc_feature (448)..(448): n is a, c, g, or t
  modified_base (534)..(534): a, c, t, g, unknown or other
  misc_feature (534)..(534): n is a, c, g, or t
  modified_base (653)..(653): a, c, t, g, unknown or other
  misc_feature (653)..(653): n is a, c, g, or t
tcagagtcgagagacacgaccggtgctcgatttagtctagcgactttgggtttgggggtgggcgtcaggaggcagacgctctgggaatctcaccatggcctggaccctctcctgctcccctcctcactttctcgcacacgtctctgacggcctctatagacgcgtagacacgacgccaccgtcggtgtccggtcgtcccgaggacgaaacgccaggtactaacctcgctcgtggacgatcgacgtattacgaacctaaaaaacttcgtacgtacttggtacggtaaccaaggtaaacgtaacgttacgacggtaccgtacgggtacccggtagttacgacctacgtactactacgtacgaaccgaanaacgaaaaccgcccgtacgggacctaccgtacgagtacgtacttcgtcgtcgactcacgtacgacgactgcgaccgtgtanactactcgacggcggactggtacgagagtagacgacgtaactacttagtactactacgaccgaacacgttaaccagttaacgaaancgtaaacaagtaagtaagtacgtacggaacgggaagtaaccaaggtcaacggtaacctacgtacgtacgactaccggtcggactaccgcccgtagtcaacctacgttccacccgtaccncgtcttacg

SEQ ID NO: 70488 - DNA, 832 bp, Homo sapiens
  misc_feature: GYAE6OF02I8JT4.49.26.C04.1.454.CMB.1.raw
  modified_base (293)..(293): a, c, t, g, unknown or other
  misc_feature (293)..(293): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcggtggtagagccgtggggggtccctgagactctcctgtgcacgcctctggattcattctttgatgatttangccattcgcactaggactccgtacaaggtccggtaccggggggaagggttccgtgggtacggttcggggttaccttcgtttacgttttaagtttaaacggtttggggtaaggttgggtttacgggttaacttaccgtaacccttaaccttagttcggacctaaggtacctttcgttcgggttacgggtaaacggggggtttacctaacgtttttacccgaaacccttacgttaaccccgttacccgaaacgggaaccgtaaccgaaaaccgtacgaaccgtaaaccggtaaaacccctttcccgtttaaggttaaccttacccgtaagggaaccctaaaaagtcgaaaaccgtagttaccgttagaacgggtaacgggttagggaaccggtaaccccgtacccggttaccctttaccggttaaccttacggttacggttacggaaacgttaaaaacgggttcggttttacccgaaccgtaaccccttacgttaacccgttttaacgttttacccgggtacccctaaggttaccccgggg

SEQ ID NO: 70489 - DNA, 676 bp, Homo sapiens
  misc_feature: GYAE6OF02FRL81.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtcggggggtccctgagactctcctgtgcagcctctggattcatctttgatgattatgccatgcactggatccgtacgaagcgtaccgggggaagggtcgtgggtaggtgggtcttctactttatttaagttgggtattggtaggtactcaccttactagtgcagtactctggtaggtacgggtacgtacttaccacctactcctaccgaagaacgaaccaaacggactaccgaaacgtaaacccttcccgtagttactccgtacgaactaaacgttacgaaactacgttcctacgaacggtaggtaggaacggtaacccgacccgtacccgtttactaccttaacgtgggttaaccaacgtaaaaggttacgttaaccggtacgtaacccgtaaccttaacccgttttaacgtttttaccggacccgttaacgtacccgggg

SEQ ID NO: 70490 - DNA, 731 bp, Homo sapiens
  misc_feature: GYAE6OF02FSSUI.49.26.C04.1.454.CMB.1.raw
  modified_base (245)..(245): a, c, t, g, unknown or other
  misc_feature (245)..(245): n is a, c, g, or t
tcagagtcgagagacacgaccggtgctcgatttagtctagcgactttgggtttggggtgggctcaggaggcagagctctgggaatctcaccatggcctggacccctctcctgctcccccctcctcactttctgcacagtctctgaggcctcctatgagctgacacagcccaccctcggtgtcggtcgtccccaggacaaacggccaggataacctgctctggagatgcattgaaccaaaaaaatntgtacttgttggtaccagaagaagtcgaggccaggtccccggtgttcgctcatctatcgaacgacgtaacggaaaaaccgtccccgtaccggggactccccgtaggaagtacgtatttccgtcgtcggcccttcccgaaccctcgaacgggaccagtccggaccgtacggttacgacttacgtcgacgggcccggggtacccgtagggtacggaggtagtagggtaaggtacgacttacgtattacgtaccttaccgaacctaacgacctaactaggtaacgtaaaactcgaacgtaaaggaagtaacggtacggttaccgggaacggggacgggtaaccaacgggccgttaacggtaacccgttacggttacggccggtaaccgacccggtaacgggtacccttccccgggtacccccgttaccgggtccctaaccgtttcccgtcccggtttaccccctaccccgtttccttacccttccccgg

SEQ ID NO: 70491 - DNA, 811 bp, Homo sapiens
  misc_feature: GYAE6OF02J06Y5.49.26.C04.1.454.CMB.1.raw
tcagagtcgagagacacgaccggtgctcgatttagtctagcgactttgggtttggggtggggctcaggaggcagagctctgggaatctcgaccatggcctcggaccctctcctgcctccccgtcctcacttctgcacagtctctgacggcctcctatgagctcgacacacgccaccctcggtcgtccggtcgtccccgaggaccgaaacggccaggtaactaaccgtgctacgtggacgatgcattacgaaccgaaaaaatgtacgcttggttacggtaccagaagaacgtcaggccgaggcccggtgtcgacgtcacgtctaacgtcgacgacaacgaaaaccgccgtacgggtacctccgtagtacgacgtaacttcgtacgtcggtacctaccgtaaccgtaccggacggaaccgtcggtaccggtacgacggttacgtaactacgtacggacggggtacccgggcccgggtaagggtacgggtaggtaaacggtacgggtaaacggttaacggtaaccgttacggttaacggtttaccgggtaaccgttaacccgaaacccgtacgaacccgaacgttaacggttaaacgtaaacgaccttaaagggaacggttaaacgtaaacgttaccgggttaacgggtaacggggttaaaccgaacgttaaccggaccgttaaaccggaaccggttacccgttaggaacccgtacggtacccggtaaaccgggttcccgtaaccgcccccggtttacgaacctacccggttccgacccggttttcccctaccccgttccgttacccgttcccg

SEQ ID NO: 70492 - DNA, 804 bp, Homo sapiens
  misc_feature: GYAE6OF02FQ04O.49.26.C04.1.454.CMB.1.raw
  modified_base (248)..(248): a, c, t, g, unknown or other
  misc_feature (248)..(248): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacacgccaccctcggtgtcggtcgtccccaggacaaacggccaggactaacctgctcgtggagatgctattagaaccaaaaaaatntgtcttgtggtaaccagaagaagtcgaggccagggccccggttgttcgctacgattctagtcgacgaacaacggaaaaccgaccccgtcgggactcccgtagacgaacgtcttactcgttcggacctcctacctcggaacgggtacctagtcggaccgtacggttcgtacgttactccggaacgggcccggggtacccgtaggggtacgggaacgggtagttacgggaagggttacgtaacctttaactttaacggtttacggttaaccctaccgtaacccgtaacggtaaccaaacccggtaagttaaacgaaaacctccgtaaacgaagggtaaacgtaaacggtttaacgtaccggggtaaccgggaaacggggtaacccgaaaccgggttcgttaaacccgggtaacccggttaccgttaaccggacccgttaaccgggaacccgtaacgggaccccgttaacccgggtcccccccggttaacggttaccctaacccggttcccgtttaaccccgttcccccgttaaccccgttcccttacccggttccccg

SEQ ID NO: 70493 - DNA, 650 bp, Homo sapiens
  misc_feature: GYAE6OF02HQ86Y.49.26.C04.1.454.CMB.1.raw
  modified_base (337)..(337): a, c, t, g, unknown or other
  misc_feature (337)..(337): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctctgtgcagcctctggattcattctttgatgattatgccatcgcactggactccgtacaaggcgtaccgggggaggtcgtgggnggttggtctctctttagttaagttgggtattggtaggtactccacctatatgctacgtactcgtagtggaagggttcgtaacctttcaaaccctattccctaaccgaagtagaaccaaacgcgaccaaacgtaaacccttcccttaggtacctactagtaactaaacgttcgaaactagttcctacgaaagggtcgggtacgaacgggacctacccgttcttactaaccgtacttggtaacgaaccgtaaaagtacggttaaccggtataaccccgtaacttaccgtttaagtttacccaccgagtacccggg

SEQ ID NO: 70494 - DNA, 603 bp, Homo sapiens
  misc_feature: GYAE6OF02HVH23.49.26.C04.1.454.CMB.1.raw
  modified_base (137)..(137): a, c, t, g, unknown or other
  misc_feature (137)..(137): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (563)..(603): a, c, t, g, unknown or other
  misc_feature (563)..(603): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacganagaaaacgccctccgggatccctgagagattctctggctccacctcgagggaccagtcggccacgttgactatcgaggccggggacccagggtgggaggtagtaggaaggttgacttacgtatttcggttacctaccgaaccgtagaaccaaccgtaagtaggtaaaaacgttccaacgaaggaagggtaaattaggtttaccgggacggggaacggggaacccgaaaggtaccgtacggtaaccccgttcccggtaaggtaccgaacggtacccgaagggtcccttccggcccccggttacggtcccgtaaccttccggttaccgttcccctaaccccgttccttccgtcccgttccgtcccgtaacgttccgtaggtacgggccggggtaccgtggaccgaaggccgagtacgtagcngntgcnnnnnnnnnnnnnnnnnnnnnnnnnnnnnnnnnnnnnnnnn

SEQ ID NO: 70495 - DNA, 822 bp, Homo sapiens
  misc_feature: GYAE6OF02HHV54.49.26.C04.1.454.CMB.1.raw
tcagagtcgagagacacgaccggtgctcgatttagtctagcgactttgggtttgggggaagaggaagactgacggtccccccaggagttcaggtgctgggcacggtgggcatgtgtgagttttgtcacaagatttgggctcaactctcttgtccaccttggtgttgctgagctgggttttccttgttgcttattttaaaggtgtccagtgtgaagtgcagttggtggaatcgtgggggagtcgtggtagagccggtggggggtccctggagactctcctgtcgcagcctgtggattcattctttgatgtattatcgacctatcgactacgtggtaccttcccgtcgaacggtccggtaccgggggtaagggttccgtaggggtacggttcgggttcttacgtttacgtttaagtttaacggttggggtacgtttgggttacggttaaccttccgtaacctttaacgttagtacggtactacgtacttcggttaggttaacgggtaacgggttacccgtatttaccccgaaccgtacgttaccgtacccggaaagtaccgtaaaccaacgtacgaaccgaaacgttaaaccccgtcccgttaggttaccctacggttaacgaaaccgttaaacggttacaaaccgttacggtacctaaccggtaaaggggtaaccgggttaccgggaaacccgggttaacccccgtaaccccgggtttaccctttaacgttaacccggtttacgttaaccggttaacgaaaacccggtttaaaacgggttacccggttttaacccgggtaacccaaaccccctttaaacccgg

SEQ ID NO: 70496 - DNA, 850 bp, Homo sapiens
  misc_feature: GYAE6OF02HK1J4.49.26.C04.1.454.CMB.1.raw
  modified_base (267)..(267): a, c, t, g, unknown or other
  misc_feature (267)..(267): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaagtgtcagtgtgaagtgcagttggtggaatcgtgggggagtcggtggtagagccgtggggggtccctgagactctccgtgtgcagcctntggtattcattctttagattagtattatgcctatgcgacgttggtacttcccggtacgaacggtccggtaccggggggtaacgggttcgttggggacgggttcggggttccttccgtttacgttttaagtttaaaggtttgggggtacgttaggggtttacgggtactttaccgtaaccctttaacttagtcggacctaagtaccttacgttggttaacgggtacggggttaccgtacgtttaccaacccgtacttaccctaacccggtaaaggtaaccgaaacctaaaccggtaacggaccctaaaaccgggtaaacccctttccccggttaggttaaccgttcttaaccggtaaacaaacggtttaccggaaactacggtttacgaacgtaacgggtaggggttaaccgaacggggtaaacccctaccccggtttaccctttaacttaccggttaaccggtttaggtaaaccggtaaaccgtaaaaacggttaaccggtttaaccggggaacccgtaacccgttaacccgttaacccttttaaggtttttaccccgggaaacccctacgggttacccgggg

SEQ ID NO: 70497 - DNA, 626 bp, Homo sapiens
  misc_feature: GYAE6OF02GNH3L.49.26.C04.1.454.CMB.1.raw
  modified_base (507)..(507): a, c, t, g, unknown or other
  misc_feature (507)..(507): n is a, c, g, or t
  modified_base (554)..(554): a, c, t, g, unknown or other
  misc_feature (554)..(554): n is a, c, g, or t
tcagagtcgagagacacgaccggtgctcgatttagtctagcgactttgggtttgggggggaagaggaagactgacggtccccccaggagttcaggtgctgggcacggtgggcatgtgtgagttttgtcacaagatttgggctcaactctcttgtccaccttggtgttgctgagcggtggtttcgtgtaggcgtattaaaggtgtcagtgtgagtgcagttggtggaatgtgggggagtcgtggtagacgccgtggggggtccctgaacgctctcctgtgcagtcctctggatcattctttgatgatttagctccagtgcacggtgacttccgacaaggtcctccggggggtaaggtcgtgggaggtgggttccttcttagtttagttaagttgggaagtttagggtggtactacgaccttagtaactggacaagtacctgtaggtggagttgacttccaccagttccaccgaggaacacctacacgtacaaaggtaacctccgtatntaccgaatacctaaagtcaaacgtctacgtaccaggggttaggacgngtaaacccgcctaacttccctaagttacctagggacttaacgaacggtttactacgggtactaccccgttaa

SEQ ID NO: 70498 - DNA, 679 bp, Homo sapiens
  misc_feature: GYAE6OF02ID747.49.26.C04.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (631)..(631): a, c, t, g, unknown or other
  misc_feature (631)..(631): n is a, c, g, or t
  modified_base (652)..(652): a, c, t, g, unknown or other
  misc_feature (652)..(652): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttggctgagcgtggttcgtgtaggctattaagtgtcagtgtgagtgctgtgtgatcgtggggatcgtggagngccgtgggggtcccngagactctctgtgcagcctntggaacttcatctttgatgattatcgcctatgccacgtggtaacttccggtacaaacggtccggtacgggggtaaggtttcctgggtaggttcggggttaccttccgtttaactttaagtttaaacggttgggggtaattaccgggttggttaaactccgttaaaccttaacctaaggtttctaacgacgtaacccgttcgttgggttaacggaaacggggtttctaacgttttacgacccgtttaaatccccttaacgtaacgtacggaaaccaaaacgcggtaccaaacggtaaacccttcccgttaagtaactccggtataacaaatacgtaaccgtagtcctagaggaggtcgacgctacccgtactctacttcggtanccggaaattacgattacgganaccttatacccttattacgctactcgg

SEQ ID NO: 70499 - DNA, 627 bp, Homo sapiens
  misc_feature: GYAE6OF02F5GUD.49.26.C04.1.454.CMB.1.raw
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
  modified_base (444)..(444): a, c, t, g, unknown or other
  misc_feature (444)..(444): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccacctcggtgtcggtcgtccccaggacaaacggccaggataacctggctctggagatgcattgaccaaaaaatntgcttgtgtaccagagagtcaggccaggcccgtgtgctcatctatgacgacagaaaccgcccgtaccgggatcccgnggacgagtattctctggctaccacctcgagggaccatcggacctacgttcgactgtcacggccgggaccaggtggagtagtgacggtgactatattagtactacaccgtagacacgagtacgaaancaacgagacgaatacgttacggacggtacgggaccgtaaacggcgttacggaacccgttaccgtacgggtacctaacggacccgtaaacgggtaccctccggtacccccccggttacgttacccggtacccttcccggttaccggtttaccccccttaccccgttacccttcccgttaccccg

SEQ ID NO: 70500 - DNA, 434 bp, Homo sapiens
  misc_feature: GYAE6OF02GSAFW.49.26.C04.1.454.CMB.1.raw
  modified_base (357)..(357): a, c, t, g, unknown or other
  misc_feature (357)..(357): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
  modified_base (417)..(418): a, c, t, g, unknown or other
  misc_feature (417)..(418): n is a, c, g, or t
  modified_base (420)..(434): a, c, t, g, unknown or other
  misc_feature (420)..(434): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaacgaccctccgggatccctggagagattctctggcctccacctcgagggaccatggccacgttgactatcgaggccggggcccagggtgggaggagtaggaaggtgactactattgttactcacagacaccagtagaaatcacagaggaatagtcgggacggagggacaagctcgaccgtcgtaggtcacgccgaaggctccgccccgtcggtcnctcttcgtcccgccctcctcctctctcgactcgcgcggcgggctggcagggcngtanagnngnnnnnnnnnnnnnnn

SEQ ID NO: 70501 - DNA, 847 bp, Homo sapiens
  misc_feature: GYAE6OF02HQBRI.49.26.C04.1.454.CMB.1.raw
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (504)..(504): a, c, t, g, unknown or other
  misc_feature (504)..(504): n is a, c, g, or t
  modified_base (592)..(592): a, c, t, g, unknown or other
  misc_feature (592)..(592): n is a, c, g, or t
tcagagtcgagagacacgaccggtgctcgatttagtctagcgactttgggtttggggtgggctcaggaggcagagctctgggaatctcaccatggcctggaccctctcctgcctcccctcctctactttctgcacagtctctggacggcctacctatgacgtctagacacacgcccaccgtcggtcgtcggtcncccgaggacgaacggccaggactactgcctgtganatgactacgttacgaaaactaaaaaagtctagtacgtttaggttacggtaaccaaggaaaggtaacgtacgaaccggaccgaccgggtacccggtagttcgacctactattacgtaagtacgaacgaacgaaaccgtaaaacccggtcccgtaccgggtactaccggtaggaacgtacgtacttaccgtcggtaaccggtcctacccgtaaccggtaggaacccgggtaacctggtacccgtaccggttaagttacgtaaccttaggaacccggnggggaacccggggtacccggtaggggttaacgggaagttagggtaaccgggtaaggtacgtttaacttacgttagtttaaccgtaacncccgtaaaaccgtagaacctaaacggtagtaaaacggtaaacctacgtaaaggacgttaaaacgggtaacgtttaaccggggtccggggaaacgggtaaccgggtaaacctacgggttacccgtaaacgggttaacccggttccgtaaacgggtaccgacccggacgggtaccgtacccgtcccgggtaacccgttaccggtacccttacggttcccgtttaccctaacccccggtccttcccgttacgttcccg

SEQ ID NO: 70502 - DNA, 545 bp, Homo sapiens
  misc_feature: GYAE6OF02F444H.49.26.C04.1.454.CMB.1.raw
  modified_base (238)..(238): a, c, t, g, unknown or other
  misc_feature (238)..(238): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgaccaaaaaatntgcttgttggtaccagaagagtcaggccaggccccgtgtgctcatctatgacgacagaaaacgacctcgggatcccgtgagagattctcgtcggcctccacctcgacgggaccagtcggcctacgttgactatcgaggccgggacccagggtggaggataggaaggtgactactattgttactcaaccgagaccaccagtacaaactcactagagaatacgtcgacggaggacaagctacgacgtcgtaggcacgacccaaggcctacgccccgtacgtccactctccgtcccacccttcctctccg

SEQ ID NO: 70503 - DNA, 677 bp, Homo sapiens
  misc_feature: GYAE6OF02H5ZKI.49.26.C04.1.454.CMB.1.raw
  modified_base (226)..(226): a, c, t, g, unknown or other
  misc_feature (226)..(226): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacacgcccaccctcggtgtcggtcgtccccaggacaaacggccaggactaacctgctcgtgganatgctattacgaaacctaaaaaaatgtgtacgttggttacggtaaccaaggaagtaacgtcgaacggccacgggtccccggtgttcgctcatctatagacgaacgaacgaaaaccgtcccgtaccggactccgagagacgtacttctcgtcgtacctccaccgtcgaacggactagtcgaccgtagtacgactacgtcgacgggtccgggaccgagggtacggacggtagtacggtaaggtcgtaacttacgttatttcgtaacaccgaaccgtaagacctaacgtaagtaacaaactacgaacgagtaagtaagttacggtaccgggaggaacggtacgaacgtccgacggtaaccgtcgtacggctaccggaccgaacggtcccttccggaccccgttcgtaccgtaccttccgttacccgttacccccacctttcccgtccttacccg

SEQ ID NO: 70504 - DNA, 575 bp, Homo sapiens
  misc_feature: GYAE6OF02IGDIJ.49.26.C04.1.454.CMB.1.raw
  modified_base (239)..(239): a, c, t, g, unknown or other
  misc_feature (239)..(239): n is a, c, g, or t
  modified_base (547)..(547): a, c, t, g, unknown or other
  misc_feature (547)..(547): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtgtccccaggacaaacggccaggataacctgctctggagatgcattgaccaaaaaatntgcttgttgtaccagaagagtcaggccaggccccgtgttgctcatctatgacgacagaaaacgccctccgggatccctgagagtacttctcgtggcctccacctcgagggaccagtcggcctacgttgacttagtcgaggccgggggccccagggttcggaacgggtatcggaaagggtgaacgttacttattacgtttactcaccagaacaccgaagtacgaaatcaacagagaactagttacggcggaagggaccaagctcgaccgtcgtagtcaacgcccgaacggctccggaccccgtgtaccnctctccgttccccaccctccgtctcccg

SEQ ID NO: 70505 - DNA, 409 bp, Homo sapiens
  misc_feature: GYAE6OF02FENR1.49.26.C04.1.454.CMB.1.raw
  modified_base (286)..(286): a, c, t, g, unknown or other
  misc_feature (286)..(286): n is a, c, g, or t
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
  modified_base (389)..(389): a, c, t, g, unknown or other
  misc_feature (389)..(389): n is a, c, g, or t
  modified_base (394)..(409): a, c, t, g, unknown or other
  misc_feature (394)..(409): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctcgggatccctgagagattctctggcctccacctcagggaccatggcctacgttgactatcgaggcggggccaggtggagatgagtgactactatgttactcacagacaccagtagaaatcacagagaattagtcggnggaggacagctcgaccgtcctaggtcacgacccgaaggctcgccccctggtcactctccgtcccncctctctctctcactctgacgcggcnggtacaggctanatagnnnnnnnnnnnnnnnn

SEQ ID NO: 70506 - DNA, 484 bp, Homo sapiens
  misc_feature: GYAE6OF02I9TSH.49.26.C04.1.454.CMB.1.raw
  modified_base (453)..(484): a, c, t, g, unknown or other
  misc_feature (453)..(484): n is a, c, g, or t
tcagagtcgagagacacgaccggtgctcgatttagtctagcgactttgggtttgggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcgggccaggtggagatgaaggtgactactattgtactcacagacacagtagaaatcacagagaatagtcggcggagggaccaagcgtagacccgtccgtaggtcacggaccccgaaagggcctaccggcccccctcgggtccaccgttccttccggttcccccgtccccttccctcctaccgtccttaccgccttacgtggacggtcggggtcctaggaccgaagggccgtacgagtagcgnnnnnnnnnnnnnnnnnnnnnnnnnnnnnnnn

SEQ ID NO: 70507 - DNA, 651 bp, Homo sapiens
  misc_feature: GYAE6OF02HFNPC.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtggggggtccctgagactctcctgtgcagcctcgtggattcattctttgatgattatgccatgctactggactccgtacaacgtcgtaccggggaagggttcgtgggtaggtgggtctcttacgttatttaagttgggtagttggtgtactctaacctatatcgacgtacgtactcgttaggtaggaacgggttacgtacttaccgacctacgttcctaaccgagaacgtaacaaacacggctaaaacgaacccttccttagtacttcgacgactaaattcgaacgtattacgtgaagggtacggtagggaaccgtaccggtaaccctaccgtttactaaccttacgtgttaacggaaacgtaaagttcccggtttaacgggcctaacctaacccg

SEQ ID NO: 70508 - DNA, 647 bp, Homo sapiens
  misc_feature: GYAE6OF02JGB9B.49.26.C04.1.454.CMB.1.raw
  modified_base (622)..(622): a, c, t, g, unknown or other
  misc_feature (622)..(622): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtgggtagagccgtggggggtccctggagactctcctgtgcagcctctggattcattctttgatgattatgccatgcacgtggactccgtcgaagccgtccgggggaaggtcgtgggagtgggtctcgttctttagttagtgggtattggtggtactccactactatgcatctgtgtaggaagggtcgtattccgacctatcctaccgagacgtaacaacgtacgaccaacgtaaacctcccgttagtactactacggaaccaaagttacgaaactacggtactacaaggggttgggtagaaccggtaccgtaacccgttctttaccgtaccttacggtcggtaacgaaccgtaaaacggtccgtttaaccggtacggtaacccacgtttaacccgtttntttacccggaccctacggtaccggg

SEQ ID NO: 70509 - DNA, 651 bp, Homo sapiens
  misc_feature: GYAE6OF02JXLCF.49.26.C04.1.454.CMB.1.raw
  modified_base (510)..(510): a, c, t, g, unknown or other
  misc_feature (510)..(510): n is a, c, g, or t
  modified_base (558)..(558): a, c, t, g, unknown or other
  misc_feature (558)..(558): n is a, c, g, or t
  modified_base (645)..(645): a, c, t, g, unknown or other
  misc_feature (645)..(645): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggtttccttgttgctattttaaaaggtgtccagtgtgaagtgcagttggtggaagtctgggggagtcgtggtagaggccgtggggggtccctggagactctcctgtgcagcctcgtggtattcctattctttgatgtattatcgtcctatgctacgtcggtactaccggtacgaacggtccggtccgggggtaacgggtcggtacggggtaggttcgggtctcgttactttaagttaggttgggtagttgggttacggtactaccaccttactacgtcgacgtacgtactcgtggtaggtaacgggttacgtacttccaaccgttctccgtaccgagtaacgaactaacgacgaanaaccggtaacctcccgttagtactcgtagactaacgtcaagtccgtanacgaggaggtcgaacgtacctccgtccttacacgtcgtagtaacgaactaaaggtctaacggacacctaccgttattcgtaccgacngtacgg

SEQ ID NO: 70510 - DNA, 783 bp, Homo sapiens
  misc_feature: GYAE6OF02G3MJ7.49.26.C04.1.454.CMB.1.raw
  modified_base (248)..(248): a, c, t, g, unknown or other
  misc_feature (248)..(248): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtcgtccccgaggacaaccggccaggactaactgctctggagatgcagttacgaaaccaaaaaatntagtcgtttggttacgtaaccaagaaaggaacgtcacggccgacgggtaccccggttgttcgctcatctatcgacgaacaagaaaacccgcccgtacggactccctgacgagtacttactcgtacggccttaccaccgttacgacgggaccacggtaccggaccgttacggtacgtaactacgttccgacgggcccgggtaccggagggtacgggaagggtacgtaggaaacggtaggtaccttacgttatttacgttactaaccgaccgtaacgaccaacgtaagtacgtaaaactcaacgtaagaaggtaacttacgggttacgggacccggggtaacgggtaaccgaacgggtacccgtacggtaaccccggttaccggtttaccgggtaacccgacccgggtaaccccggtaaaccggggtccccgttacccccgggtacccccccgggttaacggtttacccctacccggtttacccgttttaccccgggttcccccccgtacccgttttcccccgttatttccccccgg

SEQ ID NO: 70511 - DNA, 681 bp, Homo sapiens
  misc_feature: GYAE6OF02I50JE.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttggggtgggcgtcaggaggcagagctctgggaatctcaccatggcctggacccctctcctgctcccctcctcactttctgcacagtctctgaggcctcctatgagctgacacagccaccctcggtgtcggtgtccccaggacaaacggccaggataacctgctctggagatgcattcgaccaaaaaaatntgcttgttgtaccagaagaagtcaggccaggccccggtgttcgctcatctatgacgacaagaaaacgaccctccgggatcccgtgacgagtacttctctcggcctcaccgtacgacgggaccagtcggacctacgttgacctatccgaggtccggggcccagggtgggacggagtacggaaggtgtactacgttagttacgttactacgaaccgagtaaccaaccgtacgttaaagaaaacctcaacgaaggtaacggtaaagtacgtttacggggacggtaaagggaaccaaacggtacgtacggaacccgttaccgtaagggaccgtaacggtccccggtaaacgggtccttacccggtaccccccggtaggtttacccgtaaccgtttcccggtaccgtttaccccccgtaaccccgttccgttacccctttcccg

SEQ ID NO: 70512 - DNA, 403 bp, Homo sapiens
  misc_feature: GYAE6OF02JGCL9.49.26.C04.1.454.CMB.1.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
  modified_base (372)..(372): a, c, t, g, unknown or other
  misc_feature (372)..(372): n is a, c, g, or t
  modified_base (392)..(392): a, c, t, g, unknown or other
  misc_feature (392)..(392): n is a, c, g, or t
  modified_base (399)..(403): a, c, t, g, unknown or other
  misc_feature (399)..(403): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcgagcggggcccaggtggaggatgaaggtgactacattgttactcaccagacnccagtanaaaatcacagaggaatattcggcgagggacaagctgaccgtcctaggtcacgccaaggctcgccccctcggtcactctcgttcccacctcctctctctcgactcngagcggctaggcaagggtcncgatgannnnn

SEQ ID NO: 70513 - DNA, 873 bp, Homo sapiens
  misc_feature: GYAE6OF02GKTJR.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccgtaggtaggttagggttcggtcgtaggacgttcgggtttttccggtttttccgtttggttcgttacgtttttaaaaaggttttaaaggttccgtacgttaggttggtaaggtaggtcgtaggttagggtttgggtaaggtacgttcgggggtagggggtcgttcgggttagggtaggccggtccgggggttccgggtccgtaggacgtccttccgtcgtgtcacgccgtcctggtagttctattacgtttcgttagtatagttattcgcactagtcgactaggtacgtccgtaccgaacggtaccggtaccgggggtaacgggggtacggtcggtaggggtggggttccgtttacgtttaccgtttaagtttaaaggtttagggtagggttaggggtttcggttagttaccctaacccgttaacttaacgtcggtacgtacgtaaccgttccgtttaggggtaagggtaaaccgggggtacgtttactaaccgtaccctaaaccgtttctacccgaacgggtaaaggaaacccaaacgtaacggaaccgaaaaccgttaacccgttaaccccttcgttaagttacctacgaaagtaacttaaaggacctagttacctacggtaggtaacgggtaggaaccgacccgtacccttaccgttaccttagtacctgtaacgaacgtaaataacggttcgtacgacctaccgttactttacgtttccacgtacgtcgtacccgg

SEQ ID NO: 70514 - DNA, 609 bp, Homo sapiens
  misc_feature: GYAE6OF02F2N6V.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagaggccgtggggggtccctgagactctcctgtgcagcctctggattcatctttgatgattatgccatgcactggactccgtacacggtccgtaccgggggaaggtcgtgggaggtcgggtctcttcttattaagtgggtattggtgtatcacctatagtgcagactcgtggtaggaagggtctactccacctatcctacgaagacgaacaacagacaacgtaaaccttccgtagttactctagactaaatacgaaacgtagtcctacgaggtaggtacgacggacctacccgtaccttacgtacctaacgtggtaacgtaacgtaaagtaccgttacggactaaccaccgttaacctttagtttaccgaccctagtaccgg

SEQ ID NO: 70515 - DNA, 600 bp, Homo sapiens
  misc_feature: GYAE6OF02HHMCL.49.26.C04.1.454.CMB.1.raw
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctggtgcagcctcgtggattcattctttgatgattatgccatgcactggactccgtacaagtcgtaccgggggaaggtcgtgggagtcgggtcttcttctttaattaagttgggagttggtaggtatctacctatatgacagactctggtagaagggtctacttccacntccncagacacaacgancaagtaacctcctagtatctagacaaatcgaactagttactacgaaggtacgggtaggaacggaccgtaccgtacctttacttactacgtgtaacgtaacaaagttcggttaaccggtacgaaccctacttacccgtttagttttacgaccctagtccggg

SEQ ID NO: 70516 - DNA, 796 bp, Homo sapiens
  misc_feature: GYAE6OF02HF8DJ.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgctccccctcctcactttctgcacagtctctgagcctcctatgagctgacacacgccacccgtcggtgtcggtcgtcccgaggacgaacggccaggactacctgctcgtggagatgctattacgaaacaaaaaatgtgtacgttggttacggtaacagaaagaagtcgacggaccgacggtccccggtgttcgctacatctagtacgaacgaacgtaacgaaaaccgcccgtaccggactccgagacgagtacttctcgtcgcctccgactcgacggtacacgtcggccgtacgtacgacttacgacgacgggccggggacccgtagggtcgggaaggtacgtaagggtaacgggttacgtaaacttacgtttacgttacggtttaaccaccgtaaccgtaaacgtaacccgtaaccgtaagttaaacgtaaacgtacgtaaacgtaacgggaaagttaaacggttaccggttaccggggaaggggtaacccgggaaccgtaacgggttaccggtaaaccggtaccccggttaaccgttacgggtacccgaacccgggtacccggtaaaccgggttccccggtaccccgggttacccccccgttccggggttaacccttacccggttacccggtttcccccggttaccccccgttcccccgtttacccccgttcccgttaccccg

SEQ ID NO: 70517 - DNA, 775 bp, Homo sapiens
  misc_feature: GYAE6OF02FXWDQ.49.26.C04.1.454.CMB.1.raw
  modified_base (246)..(246): a, c, t, g, unknown or other
  misc_feature (246)..(246): n is a, c, g, or t
  modified_base (419)..(419): a, c, t, g, unknown or other
  misc_feature (419)..(419): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtcgtcccaggacaaacggccaggataacctgctcgtggagtatgctattagaaccaaaaaaatntagtctttggttaggtacctaaggaagaagtcgaggcccgacgggtcccccggttgttcgcctcatcttatgaacgacaacgaaaaccgccccgtaccgggtactccccgtagagagtacttctacgtggcctccgacctcgaacggaccaggtcgaccgtacgttcactacncggcggcccggggacccgtagggtacgggacggtagtaacgggtaacggtacggtaactttacggttaacttttacgttaaccgttaccaaccccgaacgtaacccgaaccgtaaggttaacaaaaaccgttccgtaaaccgaaaggggtacgttaaacgttaacggttacggggaaccggggaacggggtaaaccgtacggaccggttaacggttacccgtaccggttaacgggttaccgaaccggaaccccggtaacgggtcccgtaccccggtccccccggttaaggttccccgtacgtttcccggtttacccgttaccccccgtaccccttaccccggttcccttaccccgg

SEQ ID NO: 70518 - DNA, 429 bp, Homo sapiens
  misc_feature: GYAE6OF02HEJOK.49.26.C04.1.454.CMB.1.raw
  modified_base (415)..(429): a, c, t, g, unknown or other
  misc_feature (415)..(429): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacggttgactatcagcggggccaggtggaggatgaaggtgactactattgttactcaccagacacagtgaaaatcacagaaggaattattcggcggacgggacaagctcgaccgtcctaggtcagcccaaggctacggccccctcggtcactcctcgttccccacctccctctctctccgacttgtcgacggcgggctgggactaacgggcgcagtagnnnnnnnnnnnnnnn

SEQ ID NO: 70519 - DNA, 641 bp, Homo sapiens
  misc_feature: GYAE6OF02J2PJ8.49.26.C04.1.454.CMB.1.raw
  modified_base (299)..(299): a, c, t, g, unknown or other
  misc_feature (299)..(299): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
  modified_base (515)..(515): a, c, t, g, unknown or other
  misc_feature (515)..(515): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgtctatttaaaggtgtccagtgtgaagtgcagttggtggtatcgtggggggagtcggtggtaggagccggtggggggtccctggagtacctctcctgtagcgacgcctcgtggtattcagttctttagagtntattatgccctatgcacgtgtacgtccgtcaacggtccgtcgggggaaggtcgtgggtaggttcgggtctcttcttagttagtggtgtggtagtctcctaccttagtgtacgcgtacgtacttcgtagtaggtagggtacgtactttccaacngtccctacaggaanccaaagcgacaaactacctctagactacngaaactaagtcaattacganacgtataaggggccaggtaccctaccggtttacctacgtacttaacggtgaacgtaaacctaaggttaacgttccggaaaccctacctaccgtttacgtttacggtacccacccgggtataccggg

SEQ ID NO: 70520 - DNA, 748 bp, Homo sapiens
  misc_feature: GYAE6OF02IBDDC.49.26.C04.1.454.CMB.1.raw
  modified_base (243)..(243): a, c, t, g, unknown or other
  misc_feature (243)..(243): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacgagccaccctcggtgtcggtgtccccaggacaacggccaggataacctgctctggagatgcattgaaccaaaaaaatntgtcttgtcgtaccaagaagaagtcaggccacgggtcccgtgttcgctcgatctatgaccgacaacgaaaaccggccccgtacgggactacccgtaggaacgagtacttctcgtcggccttacccacctacgacgggacctagtcggacctacgttcgactacgtacgacgggccggggcccgtaggggtacgggtaacgggtacgttagggaaagggttcgtaaaccgttaacgtttacgtttacggtttaaccctaccgaaccgtaaacgaacccgtaaccgtaaaggttaacgaaaactcgaacgtaaagggtaagggtaaacttagggttaccggggaacgggtaaccgggaaccgtaaacggtacgtacccggtaaccgttaccgtacgggtaccgaaccggaccgtaaccgggtcccttcccggtacccccgttcggtacccgtaccgttcccggttccccggtttaccccccgtcccgtttccccttaccgttccccg

SEQ ID NO: 70521 - DNA, 771 bp, Homo sapiens
  misc_feature: GYAE6OF02FJA0E.49.26.C04.1.454.CMB.1.raw
  modified_base (238)..(238): a, c, t, g, unknown or other
  misc_feature (238)..(238): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccaccctcggtgtcggtgtccccaggacaaacggccaggataacctgctctggagatgcattgaccaaaaaatntgcttgttgtaccagaagaagtcaggccaggccccggtgttgctcatctatcgacgacaacgaaaaaccgaccccgtaccgggactcccgtgaagagacttctctggctccgacctcgacgggaccagttcggaccacgtttcgaactagtcgacgggccgggggacccgtaggggtacgggaagggtacgtacgggtaaagggtacggtaacttaacgtttaagttttcggtttaaccttaccgaaacctaacggtaaaccaacccgtaaacggttaaacgaaaaacttccgaaaccgaaagggtaaacggttaaagtaacggtttccgggaaccgggggtaacgggtaaaccgtaaacgggtaccttaaccggggtaacccgttacccgggttaaacgggttaccgaaaccgggtaaccccggtaaaacgggtcccgtacccgggtaacccccccgttccgggtacccgtaacccgtttcccgttacccggtttacccccctacccccgtttacccttcccgtttaccccg

SEQ ID NO: 70522 - DNA, 397 bp, Homo sapiens
  misc_feature: GYAE6OF02H9E04.49.26.C04.1.454.CMB.1.raw
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (384)..(384): a, c, t, g, unknown or other
  misc_feature (384)..(384): n is a, c, g, or t
  modified_base (390)..(397): a, c, t, g, unknown or other
  misc_feature (390)..(397): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtgaggatgaggtgactactattgtactcaccagacacagtgaaaatcacagaggaatattcggcggagggaccaagctgaccgtctaggtcagcccaagctgccccctcggtcactcngttcccncctcctctctctcgactctgagcgggctggcaagggcncgatgnnnnnnnn

SEQ ID NO: 70523 - DNA, 648 bp, Homo sapiens
  misc_feature: GYAE6OF02JZXMS.49.26.C04.1.454.CMB.1.raw
  modified_base (244)..(244): a, c, t, g, unknown or other
  misc_feature (244)..(244): n is a, c, g, or t
  modified_base (299)..(299): a, c, t, g, unknown or other
  misc_feature (299)..(299): n is a, c, g, or t
  modified_base (497)..(497): a, c, t, g, unknown or other
  misc_feature (497)..(497): n is a, c, g, or t
  modified_base (526)..(526): a, c, t, g, unknown or other
  misc_feature (526)..(526): n is a, c, g, or t
  modified_base (574)..(574): a, c, t, g, unknown or other
  misc_feature (574)..(574): n is a, c, g, or t
  modified_base (595)..(595): a, c, t, g, unknown or other
  misc_feature (595)..(595): n is a, c, g, or t
tcagagtcgagagacacgaccggtgctcgatttagtctagcgactttgggtttggggtgggctcaggaggcagagctctgggaatctcaccatggcctggacccctctcctgctcccctcctcactttctgcacagtctctgaggcctcctatgagctgacacagccaccctcggtcgtcggtgtccccaggacaaacggccaggactaacctgactcgtggagatgcattcgaaccaaaaatntgcttgttaggtaccagaagagtcgagccgacggcccggtgttacgctcatctancgacgacaacgaaaaccgacccgtaccgggacctcccgtacggacgagtacgtttactccgtaggtacccgtcctaacccgttacgacggggtaacccaggttacggcccgtaacggtttagtacctaacgttccgacggggtccggggacccgtagggtacgggagggagtaggacggtagacgtatagttcgtacnccgtacacgactacgaacgagtaactaanacacgaagtaagtagtacggtacgggacgtacgaccagtcaccgtacncggacgagtaccgccggtacncgtcccgtcgtaccggcttaccggtcctacccgtccccgtacctccctaccgg

SEQ ID NO: 70524 - DNA, 643 bp, Homo sapiens
  misc_feature: GYAE6OF02FWLRB.49.26.C04.1.454.CMB.1.raw
  modified_base (288)..(288): a, c, t, g, unknown or other
  misc_feature (288)..(288): n is a, c, g, or t
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagcctggggggtccctgagactctcctgtgcagcctctggtattcatctttgatgattancgccatgcactggactccgtcaagcgtccggggaaggtcgtggngtggtctctcttattagttggatggtgtanctacctatntgcagtactctgtggaacgggtcattccacactcctacagacgaacacgacgcaaacgtaaccttccgtagtacttaccgagtaaccaaaggttacgaacgtcgtaccgtagaagggttacggtacggaacggtaaccccgtacgtacccgttttacctaacgttacgttacgggtaaacgaacgttaaaaaccgttccggtttaaaccgggtacctaacccggttaaccttacccgttttaacgtttacccgacccgtacggttaccgggg

SEQ ID NO: 70525 - DNA, 925 bp, Homo sapiens
  misc_feature: GYAE6OF02H4TCC.49.26.C04.1.454.CMB.1.raw
tcagagtcgagagacacgaccggtgctcgatttagtctagcgactttgggtttggggtgggctcaggaggcagagctctgggaatctcaccatggctggacccctctcctgctcccctcctcactttctgcacagtctctgacggcctcctatgagctgacacacgcccacccgtcggtcgtcggtcgtccccgaggaccgaaacggccaggactaacctgctcgtggagatgactattacgaaacctaaaaaaatgtacgtacgtttaggttacggtaaccgtaaggtaaagtaacggtacgaacgggtaccgaaccggggtcccccgggttaggttcggtaccttaccgaactttaccgttaacgttaccggaaccgtaaaccgaaaccggtaaaaaaccccggtacccccggtaccgggtaacccgttaccccgtaggaacggtacgtacttacgttaccgtcgggtaccctaccccgtaccgtaccggaacgggtacctaacggtacggtacccgtacgtttacggaaccgttacgtacgaccggggtacccgggtcccggtaaggggtacgggtaaggtaacgtggggtaaacggtacggtaacttacggttacttacgttaaccgtaccaacgtacgaaccttaacggtaagtaacgtaaacctcgaacgtaaacgggtaagttaaacgttaacgggttacccgggaaacgggggtaaccgggtaaaccgtaaacggggtacccgttaacccggtaaccgggtttaccggtaaccgggacccgtaaccggggtaacccccgaaggggtacccgttacccccgggtacccccgttttaccggtacccgttacccggttacccgtttaacccccggttacccccggttaaccccgtttcccccgtttcgttaaccccccgg

SEQ ID NO: 70526 - DNA, 869 bp, Homo sapiens
  misc_feature: GYAE6OF02GPXF2.49.26.C04.1.454.CMB.1.raw
tcagagtcgagagacacgaccggtgctcgatttagtctagcgactttgggtttggggctctaggggaaaggagccccagccctgagattccccaggtgtttccattcggtgatcagcacgtgaacacagaactcaccatggagtttgggctgagcttgggtttttccttggttgtactttaaagtttttaaaaaggtcgtccaaggttcgtaggtaacggtggtcgtaggtttagggtaggaaagttcgtagggggagttcggtagggtaggacggtcccggtcggggggtaccctgggacggtaaccttcgtccgttggtcgaccgaacgtccttcgtaggtactttacgtagttccgttttagacttaggtactttaacgtccggtacccctaagtcgacttaacgtaggaactccggacgaacgtccggtaccggggtaaaggtccgtagggtacggttccggtactcgtttacttaacgttaaggttgggagtttacggtagttaacgtaaccgtaaccttacgttagtaccgactacgttacttacgttacggtacggtaacggtacttaaccgtacaaccgtatccgtaaccgaaggtaaccgaaacgacgttaaccgtaacgttaaaccgtaacccgtttacgtcttaacccggttcaacggttaaaccgtaaaagtcccgtaaaacgtaccggttccgttaaagggtaacgggttaaccgggtaacgggaaccgttaaccccgaaaccggttaccctttagtaaccgttcgttaacggtacgaaaaacgtaacggttaccgttaacggtacccaacccggttaccgttactttaaccgtacggtaccctccggtaacccgg

SEQ ID NO: 70527 - DNA, 801 bp, Homo sapiens
  misc_feature: GYAE6OF02GLOU4.49.26.C04.1.454.CMB.1.raw
  modified_base (523)..(523): a, c, t, g, unknown or other
  misc_feature (523)..(523): n is a, c, g, or t
  modified_base (651)..(651): a, c, t, g, unknown or other
  misc_feature (651)..(651): n is a, c, g, or t
  modified_base (784)..(784): a, c, t, g, unknown or other
  misc_feature (784)..(784): n is a, c, g, or t
tcagagtcgagagacacgaccggtgctcgatttagtctagcgactttgggtttggggtgggctcaggaggcagagctctgggaatctcaccatggcctggaccctctcctgcctccccctcctcactttctgcacagtctctgacggtcctcctatgagctgacacacgcccaccgtcggtgtcggtcgtcccaggacgaacggcaggactacctgctcgtaggagatgactaacgttacgaaaaccaaaaaaattgtagttacgtttacggtttacggtaaccgtaaggaaaacggtaaacgtccgaacggtacccggtaacgggtcccccgggtttgtttacggcctcgtattccgtaagttacggaaccgtaaaccgaaacggaaaacccgtaccccggttacccgggtaccttccccggtaagacgggtaattacgtttccgtcggttccggacccttcccgtaaccgtaccggaacggacccgtaggtaccggtaccgtaacggttacgacgttaacncgggaccggggcccgggtacggtaaggggtcgggaaggttacggtaaacgggtaagggttacgtaacgtttacgttagtttaccaacttacccgtaacgaaccgaacctaaccgtaagtaacgtaaanacgaagaacggtaaagtaacgttaagtccggggtacggacgaacgtaggtaccgtacggaccgttacgacggtacgaccggacgtaccggctacccgtccggttacgccgttacgtcccgttccgttaccccncccgtttcctattcccg

SEQ ID NO: 70528 - DNA, 816 bp, Homo sapiens
  misc_feature: GYAE6OF02H3G4L.49.26.C04.1.454.CMB.1.raw
  modified_base (317)..(317): a, c, t, g, unknown or other
  misc_feature (317)..(317): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttcttgttgcttattttaaaaggtgtccagtgtagaagtgctaggttggtaggaatcggtgggggagttcggtgggtagaggccggtcggggggtccctggacgtactccttccgtgtgctacgcctcgtggtattcctagttctttgattgtaattancgctagtcgacacgttcggaaccttcccgtactaaggtccgggtacggggggtaacggttcggtcgggtagggtttcgggttccttaccgttacttttaacgtttaaggtttacgggaattggggtttacgttaaccttaccctaacccgtttaacgttacgtcggtaaccgatttaacccgtaccggttagggtaacgggttaaacgggggtttaccgttaaaccgtttcccgaaacccgtttctacccgttacgaacggacgtaaaaccgacgaaaaccgtacgtaaaaccgtaacccgtttacccgtagttaacttacgtaacggaaacctaaggtaacgtaaactcggtaacgtcggaaaggttacggacggaacgaccgttaacccgtacgtttacctacggttaagtaccggtaacggaaattaaacggtaccggttaacgtaacccgtacttaaccgtaccgtttacgttaaccgtaccctaggtacccggg

SEQ ID NO: 70529 - DNA, 734 bp, Homo sapiens
  misc_feature: GYAE6OF02FYLDA.49.26.C04.1.454.CMB.1.raw
  modified_base (337)..(337): a, c, t, g, unknown or other
  misc_feature (337)..(337): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgaggcctcctatgagctgacacagccaccctcggtgtcggtgtcccaggacaacgccaggactaacctgctctggagatgcattagaaccaaaaaaatatagtcgttggttaggtaccaagaaagtaagtacagggaccacggaccccggtgttcgctcgatctatgaacgacaagtaaaccgacccgtcgggacncccgtgagagtattcgtctgcctaccgaccgtcgaacgggacctagcggtaccgtacgttacgtaactacgtacgacggcccggggaccgtagggtcgggaaggtacgtaagggtaacggtcggtaaacttaccgttaatttaccggttaacctaccgaaacccgtaggaaccctaacgtaacggtaacgtaaaaccgttaaccaacgtaaacggaaacgggtaacgttaacgttaccgggggacgggtaaacgggaccgtaaacgccgttaagggaccccgttccggtaaccgggttcaacccgggtcccaaagggtccctaacccggcccccggttccgtacccgtaccttccggttaccggttcccccgtccccgtttaccgtccctttacccg

SEQ ID NO: 70530 - DNA, 787 bp, Homo sapiens
  misc_feature: GYAE6OF02JHZ4H.49.26.C04.1.454.CMB.1.raw
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatcgagctgactacacgccacctcggtgtcggtcgtacccaggaaccaacggccaaggactaactcgctcgtggagagtgactagttacgaactaaaaactgtacggttacgtttacggttacggtacctaaggtaacgtacgtacgacggtaccggtacggtacccggttacggttacgtaccgtacgtacgtacgttacgtacggtaaccggtaacgaaccggtaaacccggtacccggtaccggtaccgtaccggtacggtaacggtacgttaccgttaccgttacgtaccggtacctaccgtaccggtacggtaaccggtaccgtacggtaccgtaccgttacggttacgtacgtaccgtacggacgggtaccgggtacggtagggtacggaacggttacgtacgggtaacgtcgtaacgttacgttacgttaccgtaccgtaccgtacggtaactaaccgtaacgtacgtaaacgtacgtaccgaagtaacggtaagttaaccgtaccggtcgggtaacggaccgtaacgtacgtaccggtacgtaccgtacggttccgacgaccgtaccggacgtccgtaccggtccgtacgacttccgtccgttacccgtacctccgttacctcgtaccg

SEQ ID NO: 70531 - DNA, 741 bp, Homo sapiens
  misc_feature: GYAE6OF02IXKN0.49.26.C04.1.454.CMB.1.raw
tcagagtcgagagacacgaccggtgctcgatttagtctagcgactttgggtttgggggggaagaggaagactgacggtccccccaggagttcaggtgctgggcacggtgggcatgtgtgagtttgtcacaagatttgggctcaactctcttgtccaccttggtgttgctgagctgggttttccttgttgctattttaaaaggtgtccagtgtgaagtgcagttggtggaatcgtgggggagtcggtggtagagccgtggggggtccctggagactctcctgtcgcgagcctgtggattcattcttgatgtattatcgaccattcgactacgtggtactccggttacgaacggcggttacccgggggaagggttcgtagggaggttcggggtcctgttacgttaagtttaaggttgggtattgggtaggttactacctaaccgttactagtcgtacgtaacgtacttcgtaggtacggggtaacgggttacgtactttacccgaacctacgttacccgtaccaaggaaccgtaaacaacgaacgtaccaacgtaaaccctcccgtagttacttacccgtaggaactaaacgttacgaaaccgttacgtacgtaacggaggtacgggtacggaaccggtacccgtaaccccggttcccgtttaacccttaaccgttaccgtaggttaaccggaaacgtaaaaccgggttctttaacccggggtaacaaccccgtttaaacccg

SEQ ID NO: 70532 - DNA, 670 bp, Homo sapiens
  misc_feature: GYAE6OF02JLJV1.49.26.C04.1.454.CMB.1.raw
  modified_base (659)..(659): a, c, t, g, unknown or other
  misc_feature (659)..(659): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgagtgcagttggtggaatcgtggggagtcgtggtagagccgtggggggtccctgacgtactctcctgtgcagcctcgtgtacttcgattcgttagagttagtattagtcgccagtcgcgactcggtactccgtacgaacggtcgtccggggaaggtcgtggaggttggtctcgttacttaagttaagttgggtatggtacgtacttactactactgtacgacgtacgtaccttgtacggtaaggagggttaccgtacttacccgaccctagttacccgacgaacggtaacgaaccgaaaccgagtaaaccgtaacctaaaccgttcccgttaattaccgactacgtaaactacgataccgtagtccaagaggtacgtacggaacttaccgacgttccttcacgtacggtagaagtaaaccttaaaggtaccggttcgtacctaacctccttaagttgttaccggaccncggttaaccgg

SEQ ID NO: 70533 - DNA, 713 bp, Homo sapiens
  misc_feature: GYAE6OF02ICKFX.49.26.C04.1.454.CMB.1.raw
  modified_base (266)..(266): a, c, t, g, unknown or other
  misc_feature (266)..(266): n is a, c, g, or t
  modified_base (529)..(529): a, c, t, g, unknown or other
  misc_feature (529)..(529): n is a, c, g, or t
tcagagtcgagagacacgaccggtgctcgatttagtctagcgactttgggtttgggggctctgggaaaggagcccccagccctgagattcccaggtgtttccattcggtgatcagcactgaacacagaactcaccatggagtttgggctgagcgtgggttttccttgttgcttaattttaaaaggtgtccagtgtgaagtgcagttggtggaatcgtgggggagtcgtggtagagccgtggggggtccctgagactctcctgtgcngcctcgtggattcattctttgattgtattatcgaccatcgctacgtggtacctccgtacgaacgtccggtaccgggggtaaggttcgtagggaggttcgggttcctcgtttactttaagtttaaggttgggtagttggttggttataccacctatatgactagtactcgttgggtaggaacgggttccgtaatttccgaacctacttacccgaccgtagaaaccgtacaaacgacgactaaacgaaaccctttccctagtacncgtacgaaactaatcgaaacgtagttacctagacgggtagggtacgaacgggtaacccctacccgttaccctttacgttaccctacggttaggtactaaaccggtaaaagttaccggtttaaccgggacctaccgttaacccttaccgtttttaaggttttacccaaccccgtggtaacccggg

SEQ ID NO: 70534 - DNA, 417 bp, Homo sapiens
  misc_feature: GYAE6OF02GSPVC.49.26.C04.1.454.CMB.1.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (398)..(417): a, c, t, g, unknown or other
  misc_feature (398)..(417): n is a, c, g, or t
tcagagtcgagagacacgaccggtgctcgatttagtctagcgactttgggtttggggagatgcattgccaaaaaaaatatgcttgttggtaccagaagaagtcaggccaggccccggtgttgctcatctatgacgacagaaaaacgaccctccgggatccctgagagattctctggctccacctcagggaccatggccacgttgactatcagcgggccaggtggaggatgagtgactactattgttacncaccagacaccagtagaaaancacagaagaatattcggcggaggacaagctgaccgtctacggtcacgaccaaggctcgcccctggtcactctcgttcccgcctcctctctcgtcactctgacggcgggctagggctaggcgcatacgnnnnnnnnnnnnnnnnnnnn

SEQ ID NO: 70535 - DNA, 743 bp, Homo sapiens
  misc_feature: GYAE6OF02F63JF.49.26.C04.1.454.CMB.1.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggcctcctatgagctgacacacgccaccctcggtgtcggtcgtcccaggacaaaccggcaggactaacctgctcgtgganatcgctattcgaacctaaaaaaatntagtctttaggttacggtaacctaggaagtaagtacgacggaccgacgggccccggttagttcgctcgactcgtatcgaaccgacgaaaccgaaaaccgtaccccgtaccggactacccgtagaacgacgtatttccgtcgtcggtcctccccgtacgtaccgtaccgggacctaaggtcggacccgtaggttacgactacgtacggaccgggcccggggacccgtaggggtacggtaacgggtcggtaagggtaaacgggtctaaccgtttacgttacgtttaccgttaccgttaccgaaccgtacgaccgtaacgaacgtaacgtaaacacgaacgacggtaaacggtataacgggttcggaaccgggtaaggcccgtaaggtcctacggtacccgtacggtacggtaccgaccgtacccggacgggtaccctcccggtccccgtgtccctacgtcccgtttaccgtccccacccgttccctccgttaccc

SEQ ID NO: 70536 - DNA, 708 bp, Homo sapiens
  misc_feature: GYAE6OF02FZHVT.49.26.C04.1.454.CMB.1.raw
  modified_base (476)..(476): a, c, t, g, unknown or other
  misc_feature (476)..(476): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatctgggggagtcgtggtagagccgtggggggtccctgagactctccgtgtgcagcctctggattcattctttgattgatttatgccatgcactggatccgtacaagccggtaccggggaaggtcgtgggaggttgggttccttgttactttaagtttaaggttagggtagttgggttaggttactacctaccttactactggacaacgtacttgtgtaggtaacgggtctattcccaactacgtcctaccgaagaagaaccgaaacncgaacaaacgtaaccttccctagttactccgtacgaactaaaagtacgtaaaccgtggttacctacggaaggtaagggtacgaaccgggtaacccgtacccgttacccgtttacctaccgttaacgttacggttaacgaaaacgtaaaacgggtaacctttaaccgggtaccaaccccttaaccgtttaacccgttttacgttttaacccggaacccgttacggtacccggg

SEQ ID NO: 70537 - DNA, 773 bp, Homo sapiens
  misc_feature: GYAE6OF02GM644.49.26.C04.1.454.CMB.1.raw
  modified_base (289)..(289): a, c, t, g, unknown or other
  misc_feature (289)..(289): n is a, c, g, or t
tcagagtcgagagacacgaccggtgctcgatttagtctagcgactttgggtttgggggctctggggaaaggagccccagccctgagattcccaggtgtttccattcgggtgatcagcactgaacacagaactcaccatggagtttgggctgagctgggttttccttgttgtctattttaaaggtgtccagtgtgagtgcagttggtggatcgtgggggagtcgtggtagagccggtcggggggtccctggagtctactccgtgtgcacgcctctggtattcattctttnatacgtagttatcgcatgctacgtggtactcccgtacgaacgtccgggtaccgggggtaagggtccggtagggtacggttcggggttaccttcgttacgtttaagtttaacggttagggtaggttgggttggtaactaccgtaaccttacgttacgtacgtcaacggtaccttacgtacggttacgggtaacgggttacgtaacctttccgaacttacgtaccgttaaccgaacggtaacgaaccgtaaacacggaaccgtaaaccgttaaacccttccggttacgttactcccgttaacgacctaaaacgtacgaaaccgtacgttaccgtacgaacgggttagggtaacgggaaccgtaacccgtaaccgtttccttaaccttaccgtaacgttcggtaacggaaagttaaaaccggttacggttaaccggtaccttaacccgtacttaaccgtttagttaccgtacccggtacgttccggg

SEQ ID NO: 70538 - DNA, 660 bp, Homo sapiens
  misc_feature: GYAE6OF02FNZBB.49.26.C04.1.454.CMB.1.raw
  modified_base (458)..(458): a, c, t, g, unknown or other
  misc_feature (458)..(458): n is a, c, g, or t
tcagagtcgagagacacgaccggtgctcgatttagtctagcgactttgggtttgggggctctgggaaaggagccccagccctgagattcccaggtgtttccgattcggtgatcagcactgaacacagaactcaccatggagtttgggctgagctgggttttccttgttgctattttaaaggtgtccagtgtgaagtgcagttggtggatctgggggatcgtggtagagcgttgggggtccctgagactctcctgtgcagcctgtggattcatctttgatgacttatcgccattcgctactggtactccggtacaacggtccgtaccgggggaaggtccgttagggaggttcggggttcttcgttactttagtttaaggttgggtacttgggttacgtacttcgtacctactagtcgacacgtacttcgtaggtacggaacgggtctacgtttcaaccnttaccgtacgtaaggacgtaacaaacgtacgaccgaacgtaaaccttccgtagttaccttcgtagacctaaagtcgaaactacgtacgtacgagggtaggtacgaacggtaccctaccgtccttacttacgtacgtcggtacgaaccgaaagtttcgttacgaccgtaccaccgttacttacgtttcgaaccctcgtaccgg

SEQ ID NO: 70539 - DNA, 639 bp, Homo sapiens
  misc_feature: GYAE6OF02IGC05.49.26.C04.1.454.CMB.1.raw
  modified_base (311)..(311): a, c, t, g, unknown or other
  misc_feature (311)..(311): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaagtgtcctagtgtgaagtgcagttggtggaatcgtgggggagtcgtgggtagaggccgtggggggtccctgagctctccgtgtgcagcctctggattcattcttgatgtattatgcatgcactggactccgtnaacgtcggtaccggggaaggtcgnggagtgggtctcgtnttataagtgatggtgtatnacctatatgacagtctcgtgtaggaacgggtcgacttcacctatccctacagtanacctaanacgacaaacgaaccttacctgtaactcttacgaactaaacgtagaaccaacgttctacgaaggtacggtaggaaccgtaacccgaacccttccgttaacccttaccgtacgttacgtaacggaaccgtaaaacgggttaccgttaacgtaaccggtaccccaaccgtttaaacccttaagtttttccccggaccctaccgtaaccggg

SEQ ID NO: 70540 - DNA, 403 bp, Homo sapiens
  misc_feature: GYAE6OF02FYU42.49.26.C04.1.454.CMB.1.raw
  modified_base (236)..(236): a, c, t, g, unknown or other
  misc_feature (236)..(236): n is a, c, g, or t
  modified_base (395)..(403): a, c, t, g, unknown or other
  misc_feature (395)..(403): n is a, c, g, or t
tcagagtcgagagacacgaccggtgctcgatttagtctagcgactttgggtttgggggagatgcattgccaaaaaaatatgcttgttggtaccagaagaagtcaggccaggccccggtgttgctcatctatgacgacagaaaacgccctccgggatccctgagagattctctggcctccacctcagggaccatggccacgttgactatcaggccgggccaggtggagatgaaggtnactactattgttactcacagacaccagtagaaaatcacagaggaatattcggcggagggaccaaggctcgaccgtcctaggtcacgcccaaggctcgcccctggtcactctcgtcccacctcctctctctcgctctgagcgggctggcaggcgacatgnnnnnnnnn

SEQ ID NO: 70541 - DNA, 598 bp, Homo sapiens
  misc_feature: GYAE6OF02GWNTA.49.26.C04.1.454.CMB.1.raw
  modified_base (363)..(363): a, c, t, g, unknown or other
  misc_feature (363)..(363): n is a, c, g, or t
  modified_base (457)..(457): a, c, t, g, unknown or other
  misc_feature (457)..(457): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaggtgtccagtgtgaagtgcagttggtggaatcgtgggggagtcgtggtagagccgtggggggtccctgagactctcctgtgcagcctcgtggattctattctttggatagtattatcgaccatgcacgtggactccgtacaacgccggtaccgggggaagggtcgtgggaggttgggtcttcttntttatttaagttgggtattgggtgtactctactactatgacactctcgtggtaggtaacgggtcgtattcccaactactccacaagacaacaancgacaacgtaccttccgtatactcgtanactaaancaanctacngaggaggngacgtacctacctccttatacctagtggtaacaacgtaaaagtcgttaccggacaaccctactaaccgtttattaccgacctagtccgg

SEQ ID NO: 70542 - DNA, 524 bp, Homo sapiens
  misc_feature: GYAE6OF02JM5QY.49.26.C04.1.454.CMB.1.raw
  modified_base (170)..(170): a, c, t, g, unknown or other
  misc_feature (170)..(170): n is a, c, g, or t
  modified_base (266)..(266): a, c, t, g, unknown or other
  misc_feature (266)..(266): n is a, c, g, or t
  modified_base (331)..(331): a, c, t, g, unknown or other
  misc_feature (331)..(331): n is a, c, g, or t
  modified_base (383)..(383): a, c, t, g, unknown or other
  misc_feature (383)..(383): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (486)..(488): a, c, t, g, unknown or other
  misc_feature (486)..(488): n is a, c, g, or t
  modified_base (490)..(524): a, c, t, g, unknown or other
  misc_feature (490)..(524): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacagaaaacgccctccgggatcccctgagagattcncgtggcttccacctcagggaccatcggcctacgttgactatcaggccggggcccaggtggagatcggaaggtgaacctgttattgttacctcaccngaacacccgtaagtagaaatcaacaggaagatacgtcggacgaggaccaagctacgaccgtacgngtccagcccgaagtcctccggcccctgggtcctagtccttacccggttcccncccttccgtccctccttccgtacgtaccctcggttacgtaccggccgggtcgtacggtacccgtaaagggcccaacgtttatcgggccngtnggaactnacgnnncnnnnnnnnnnnnnnnnnnnnnnnnnnnnnnnnnnn

SEQ ID NO: 70543 - DNA, 659 bp, Homo sapiens
  misc_feature: GYAE6OF02I6UFG.49.26.C04.1.454.CMB.1.raw
  modified_base (278)..(278): a, c, t, g, unknown or other
  misc_feature (278)..(278): n is a, c, g, or t
  modified_base (631)..(631): a, c, t, g, unknown or other
  misc_feature (631)..(631): n is a, c, g, or t
tcagagtcgagagacacgaccggtgctcgatttagtctagcgactttgggtttgggggctctgggaaaggagccccagccctgaggggattcccaggtgtttccattcggtgatcagcactgaacacagaactcaccatggagtttgggctgagctgggttttccttgttgctatttaaaaggtgtccagtgtgaagtgcagttggtggaatcgtgggggagtcggtggtagagccgtggggggtccctggacgactctcctgtgcagcctcgtggtnttcattctttgatgtatttagtgcctatcgctacgtggactccgtacaaggtccgtaccgggggaacggtcgtgggcggttcgggtcttcgttacttaagtttaagtggggtacgtgggttacggtactacctacctaacttagtacggacgtacgtaactcgttaggtacgggtaacgggtactattacccgaccgtacttcctaccgaaggtaaccgaacaaacgtacgacaaacggtaaaccctccttaggtactaccgtacgaaactaaagtacgtaactacgtacgtacgaggtacggagaccgacaccgttctactatacgtggtaacaagtaagtacgttacgganaacctactacttacgttcactcgtacgg

SEQ ID NO: 70544 - DNA, 761 bp, Homo sapiens
  misc_feature: GYAE6OF02JDAGN.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcagggaggcagagctctgggaatctcaccatggcctggaccctctcctgctcccctcctcactttctgcacagtctctgaggcctcctatgagctgacacagccacctcggtgtcggtgtccccaggacaaacggcaggactaacctgctactggagatgcattcgaccaaaaaatntagcttgtgtaccagaagagtcaggccaggccccggtgtcgcctcatctactacgacgacgaagaaaccggaccgtcgggactccctaggtacgagtacttcctacgtcggtaccttccaccttcgaacgggaccctagttcggaccgtacggttcgtaacctagttaccgacgggccgggggtaccccgaggggttcgggacgggtaacgtagggtaaccgggttagtaacccgttacgttagtttaccgggtttaacttaccgaaccgtacggtaaaccaaccgtaaggtaacggtaaaataccgaaaccgtaaggaacggttaaagtacggtttaccggggaacgggtaacggggtaacctaacgggtaccgttaaccggtaacccggttcgtaccgggttacgacccgggaacccggtaacgggtcccttacccggtacccccggttccggttaaccgtcccggtttacccgttacccggtttcccccgggtccccttcccgttccgttacccccgg

SEQ ID NO: 70545 - DNA, 739 bp, Homo sapiens
  misc_feature: GYAE6OF02IAHKJ.49.26.C04.1.454.CMB.1.raw
  modified_base (313)..(313): a, c, t, g, unknown or other
  misc_feature (313)..(313): n is a, c, g, or t
  modified_base (569)..(569): a, c, t, g, unknown or other
  misc_feature (569)..(569): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgacgcgttgggttttccttgttgcttaattttaaaggtgtccagtgtagaagtgctaggttggtggaatcgtggggagtcggtggtagacgtccggttggggggtccctggacgtactctcctgtgcacgacctcgtaggtattctagttctttgagtgtattancgtcatcgactacgtaggtactaccggtacgaacggtccgggtacgggggtacggtccgtagggtacggttcggttcttacgttatttaagttagttcggtacgttgggtagtactactaccgtagtacgtacgacgtagtctcgttagggtacggtacggttacgtagttacccacgtatccctacgaagtaccgaacaaccggtaagaccgtaaaccgtaacccttcgtaatacgtaccagtaaccctaaagtntaaccgtacggtactacgggaggtaggtacgacccggtaacccttccgttaccccttaattacccgttagtagtaaccgtaaaggttaaaccggttacgttaaccccgggaaccttaccgtaaccgttaacccgtttttagtacccgtaaccccggtgtaccccgggggg

SEQ ID NO: 70546 - DNA, 723 bp, Homo sapiens
  misc_feature: GYAE6OF02J2PSU.49.26.C04.1.454.CMB.1.raw
  modified_base (254)..(254): a, c, t, g, unknown or other
  misc_feature (254)..(254): n is a, c, g, or t
  modified_base (319)..(319): a, c, t, g, unknown or other
  misc_feature (319)..(319): n is a, c, g, or t
  modified_base (372)..(372): a, c, t, g, unknown or other
  misc_feature (372)..(372): n is a, c, g, or t
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggcctcctatgagctgacacacgcccacccgtcggtgtcggtcgtccccaggacaacggccaggactaacctgctcgtggagatgcctattacgaaacctaaaaaaatntgtcgtttggttacgtaccgaagaagaacgtcgacggccgacggtcccggtgttcgctcatctancgaacgacaacgaaaacccgccgtaccggtactcccgtagagtacgtattccncgtcgcctaccctaccgtacgacggtaccagtcggcccgtacgttacgactagccgtacgggccggggaccgtagggtgggaacggtgtacggaaggtacgttaaccgttagttacgtttaccgttaacaccgtaacccgaagtaccaaccgtaaagtaaccgaaactgaacgaacgtaagtaacgttcggtaccggtacgggaacggtacgaaccgttacgtacccgacccgttacgtccggtaccgacggtaacccggtaacgggtccgtccccggtacccccgttacggtacccgttcccgtaccccggttcccgttcccccgtacccccgttccgtaccccgttccg

SEQ ID NO: 70547 - DNA, 860 bp, Homo sapiens
  misc_feature: GYAE6OF02IUBBJ.49.26.C04.1.454.CMB.1.raw
  modified_base (214)..(214): a, c, t, g, unknown or other
  misc_feature (214)..(214): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctccgtatgagctgacacagccaccctcggtgtcggtcgtccccaggacaaacggccaggataaccngctctggagatgacattcgaacctaaaaaaatcgtacgtcttagttcggtaaccaagaaggaaacgtcgaacggtccaacgggtcccccggttagtttcgaccgttacgaacttacgtaacttacggaaaccggaaccgaaaacggtaaaaaccgacccccggttaccggggtaaactaccccgtaggacgtaacggtactttcgtaccgttcggtaccttacccgaccgttcgaaacgggacctaacgtcggtaccctaacggtttacgaacttaacgtcgtaacgggacccggggtcccgtaaggggttacgggtaacggtaagtaccgggtaaacgggttacggtaaacctttaaaccggtttaggttttaaccggtttaaccctaaccgtaaccccgtaaaagggtaccctaaaaccggttaacgttaaacggaaaaactttaccgaaacccgtttaagggaaaacggttaaacgttaccggttaccggggaacggtaacgggaacgtaacgacgtaacggtaccgtacgttacggtacaaccggtacccggtaaggtacccggtacccgtacccccggttacggtaccgtacccgttccggtttacccgttacccccggtccctttcccgtaccgttaccc

SEQ ID NO: 70548 - DNA, 719 bp, Homo sapiens
  misc_feature: GYAE6OF02FIPNS.49.26.C04.1.454.CMB.1.raw
tcagagtcgagagacacgaccggtgctcgatttagtctagcgactttgggtttgggggctctgggaaaggagcccccagccctgagattcccaggtgtttccattcggtgatcagcactgaacacagaactcaccatggagtttgggctgagctgggttttccttgttgctattttaaaggtgtccagtgtgaagtgcagttggtggaatcgtgggggagtcgtggtagagccgtggggggtccctgagactctcctgtgcagcctgtggattcattctttgattgatttatcgctatgctacgtggactccgtacgacgccggtaccggggaggtcgtgggtaggtggtccttcgttcttaatttaaggttgggtagttggtagtactaccgtaccttactagtcgactaacgtacttcgtaggttacgggaacgggtacgtactttaccgacctacttccctaaccgaagtaacgaaccaacgagaacctaacgtaaaccctccggttactacgttacctacgtaactaaacggtacgtaacgtacgtttacacgtaagggagggttacgggaaccggtaacccgtacccgttaacctttaccgttaccgtgttaccggttaaggaaacccgttaaaaggttaacccggtttaccggtaaccgaacccgttaaccttaaaccgttttacgtttaacccgacccgttcgtacccgggg

SEQ ID NO: 70549 - DNA, 542 bp, Homo sapiens
  misc_feature: GYAE6OF02H18LW.49.26.C04.1.454.CMB.1.raw
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (386)..(386): a, c, t, g, unknown or other
  misc_feature (386)..(386): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (454)..(454): a, c, t, g, unknown or other
  misc_feature (454)..(454): n is a, c, g, or t
  modified_base (456)..(456): a, c, t, g, unknown or other
  misc_feature (456)..(456): n is a, c, g, or t
  modified_base (459)..(459): a, c, t, g, unknown or other
  misc_feature (459)..(459): n is a, c, g, or t
  modified_base (463)..(465): a, c, t, g, unknown or other
  misc_feature (463)..(465): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(493): a, c, t, g, unknown or other
  misc_feature (492)..(493): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (500)..(501): a, c, t, g, unknown or other
  misc_feature (500)..(501): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
  modified_base (534)..(534): a, c, t, g, unknown or other
  misc_feature (534)..(534): n is a, c, g, or t
tcagagtcgagagacacgaccggtgctcgatttagtctagcgacttttggggtttggggagatgcattgccaaaaaaaatatgcttgttggtaccagaagaagtcaggccaggccccggtgttgctcatctatgacgacaagaaaaccgacccctccgggatcccctgagagatttctctggctcccaccttcgagggaccgtggcccagttgacctatcagcggggcccagggtggaggatgaaggtcgactactattgttaacnccaaccagacaccagtanaaancagagaagaatagtcggacggaggaacagctacggacctccgtaggtacgacgacccgaaggcctccgccccgtacgtcaaccgtcttcggtcccccncctcctctcctcgtaccgtctntacgnggccggtacncgagaacggngaacctaagtcgagcagtcangnacntacnnncnacncncncacgacacncncananannanacncnnctcncanancgtnatagacgactanactctatnaccacaca

SEQ ID NO: 70550 - DNA, 655 bp, Homo sapiens
  misc_feature: GYAE6OF02F95EI.49.26.C04.1.454.CMB.1.raw
  modified_base (188)..(188): a, c, t, g, unknown or other
  misc_feature (188)..(188): n is a, c, g, or t
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (396)..(396): a, c, t, g, unknown or other
  misc_feature (396)..(396): n is a, c, g, or t
  modified_base (411)..(411): a, c, t, g, unknown or other
  misc_feature (411)..(411): n is a, c, g, or t
  modified_base (454)..(454): a, c, t, g, unknown or other
  misc_feature (454)..(454): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (559)..(559): a, c, t, g, unknown or other
  misc_feature (559)..(559): n is a, c, g, or t
tcagagtcgagagacacgaccggtgctcgatttagtctagcgactttgggtttgggggctctgggaaaggagccccagcccctgagattcccaggtgtttccattcggtgatcagcactgaacacagaactcaccatggagtttgggctgagcgtggtttctgtgctattttaaaggtgtccagtgtnaagtgcagttggtgaatcgtgggggatcgtggtagngccgtgggggtcctgagactctcngtgtcngcctctggtatttccattctttgatagtattagtcgactagtgacctactggtatcccggacgtaagccggtaccgggggaaggttcgttggggacggttcgggtcttcggttacttaaggttaagtggggtatggtaggtntacctaacctattanggtacagtctcgtaggtaggtacggtctaacggtccaaccttntctacgaacgtanactaacncgtacaaacgtaaccttcgttaattacgtcagtaactaacgctaaacgtgttccaagggtggaaacgggtcgtaacggtaccccncccgtttaccgttacctacggttataggtaacctaaaggtaaacgttacgtacgtaccgaccctaacgttaccggttattaccgacctcggtacgg

SEQ ID NO: 70551 - DNA, 748 bp, Homo sapiens
  misc_feature: GYAE6OF02H9VOK.49.26.C04.1.454.CMB.1.raw
  modified_base (244)..(244): a, c, t, g, unknown or other
  misc_feature (244)..(244): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacacgccacctcggtgtcggtcgtccccaggacaaacggccaggataacctgctctggagatgcattagaaccaaaaaatntgctttgtcgtacagtaagaagtcgacggtccacggtcccggtgttcgctacagtctatgaacgaacaacggaaaaccgtcccgtaccgggaacttcccgtaggaagtagtactttcgtaccgtacggtcctaccctaaccgtcggaacgggtacctagttcggaccctaacggtttacaacttacgtacgaacgggtccggggacccgtagggtacgggtaaggacggtacggtaaaggtgtaacccgtaagtttatttacggtaacctacgaaccgtacgaaccgaaccgttaaggtaaacgaaaaccttcgaaacgaaagggtagtaacttaacgggttcggaacgggtaacggaaccctaaggtccgtacggttaccccgtaacgtacgggtacccaacggtcccggtaaggtccccgtacccggttacccccgttcgggtccctaaccgttcccggttacccgtttacccccaaccccgttttccctaccgttaccccg

SEQ ID NO: 70552 - DNA, 669 bp, Homo sapiens
  misc_feature: GYAE6OF02F5ZUF.49.26.C04.1.454.CMB.1.raw
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (333)..(333): a, c, t, g, unknown or other
  misc_feature (333)..(333): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccacctcggtgtcggtgtccccaggacaaacggccaggataacctgctctggagatgcattcgaccaaaaaaatntgcttgttaggtaccagaagaagtcagccaggccccggtgttgctnatctatgacganagaaaacgaccncgggatacccgnacgagattcnctgcctcacctcgagggtaccatacggcctacgttcgactaatcgaaggcggggcccgtagggtagggaaggatagggtaacggtaggtaacctaattaacgttggttaaccttaccgaaccaagtaaccaacccgaagttacgtaaaacgtcaacgtaaaggaacggtaaagtacgtttacggggaaccgggttaacggggaaccaaacgggtcctaggtaacccgtacgtacggttacgacgtacccgaacggtaccgtaccggtaccccccgtacggttcctaaccgttccgtttaccggttcccccgggtaccccttcccttacccttcccg

SEQ ID NO: 70553 - DNA, 732 bp, Homo sapiens
  misc_feature: GYAE6OF02F4EF4.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctggttttccttgttgctattttaaaaggtgtccagtgtgaagtgcagttggtggaatcgtgggggagtcgtggtagagccgtggggggtccctgagactctcctgtgcacgcctcgtggatttcattcgtttgattgatttagcgtccatgccaccgttgggtaacgttcccggttacaacggtccgggttcccggggggtaaacggggtcgttaggggtaggttcgggttaccgtttctttaccgtttaagtttaaaggtttgggtaggttgggttaggttacttaccgtaaccttaacgtttacgtcgtaccgagttaccgtcgttggtacgggtaacgggtcgtaacgtttacccaactacttcccgtacaacggtaacgaaacctaaccgaagtacccaaacgtaaaccctcccgtttagtaccgttactacgaacctaagttacgaaaccgtcgtacctacgaagtacgggtacgaacgccgtacccgtaccttaccgtacctacgtacgtacgaaacgtaacgtaacgttaccggtactaaccgtaccttaacttcgttacaccctagtaccgg

SEQ ID NO: 70554 - DNA, 671 bp, Homo sapiens
  misc_feature: GYAE6OF02F6T7D.49.26.C04.1.454.CMB.1.raw
  modified_base (247)..(247): a, c, t, g, unknown or other
  misc_feature (247)..(247): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagcccaccctcggtgtcggtcgtccccaggaccaaacggccaggataacctgctctggagatgcattcgaaccaaaaaaatntgtcttggttaggtaccagaagtaagtcacggaccgacggtccccggttagttcgctacgtactacttagcgtaacgacgaacggaaaccgcccgtaccgggactcccgtagacgagtacttcgtctcggacctccaaccgtcgtaacggggacctagtcggtacctacggttacgacttaacgtcggacgggtccggggacccgtagggtacggacggacgttagggaaggtcgtaacgttacttagttcgtacttacgaaccgacgtaccaacgtagtaagaaactccgaatacggagtaatcgtacgggaggtacggaacgagtactcgtaccggtacgtaccgacgacgaccgaaggtcccgtaccgtaccccgttgaccgtaccgttccgtaccgttccccgcccttccgtacttcccg

SEQ ID NO: 70555 - DNA, 642 bp, Homo sapiens
  misc_feature: GYAE6OF02IJ41G.49.26.C04.1.454.CMB.1.raw
  modified_base (367)..(367): a, c, t, g, unknown or other
  misc_feature (367)..(367): n is a, c, g, or t
  modified_base (448)..(448): a, c, t, g, unknown or other
  misc_feature (448)..(448): n is a, c, g, or t
  modified_base (605)..(605): a, c, t, g, unknown or other
  misc_feature (605)..(605): n is a, c, g, or t
tcagagtcgagagacacgaccggtgctcgatttagtctagcgactttgggtttgggggggaagaggaagactgacggtccccccaggagttcaggtgctgggcacggtgggcatgtgtgagttttgtcacaagatttgggctcaactctcttgtccaccttggtgttgctgagctgggttttccttgttgcttattttaaaaggtgtccagtgtgaagtgcagttggtggaatcgtgggggagtcgtggtagagccgtggggggtccctgagactctcctgtgcagcctcgtggattcattctttgatgtattatgccatgctacgtggactccgtacagcgtaccggggagtcgtggagtggtctnttcttattagtggatggtgtactctaacctagtatcgtacagtacttgtaggtaggtaacgggtcgtaattaccgaacctntaccctacgaagaacgtaaccaacgacgactaaaccggaaaccttcccgttaagtacgttacctagaacaaacttacgaactacgtactacgaggtaggtacggaacggacccgtccgttaacccttaccgttacttaacggttaacacggttaaanaaaacggtttacgtaaccgggtaccacccgttaaccc

SEQ ID NO: 70556 - DNA, 749 bp, Homo sapiens
  misc_feature: GYAE6OF02I9P3B.49.26.C04.1.454.CMB.1.raw
  modified_base (248)..(248): a, c, t, g, unknown or other
  misc_feature (248)..(248): n is a, c, g, or t
tcagagtcgagagacacgaccggtgctcgatttagtctagcgactttgggtttggggtgtgctcaggaggcagagctctgggaatctcaccatggcctggacccctctcctgcctccccctcctctactttctgcacagtctctgaggcctcctatgagctgacacacgcccacccgtcggtcgtcggtctcccgaggacaacggccagataacctgctcgtggagatgctatacgaaccaaaaaatntgtctttggttacggtaccgaaggaaacgtaacgtcgacggccgacgggtcccggttgttcgcctactactctatacggaacgtaacgaaacggaaaaccccggtacccggtaccggtactacccgtagacgtaacgtacttccgtacgtccggaccttacccgaccgtacgtaaaccggctacggtccgtccgtaacgttgaaccttcggaccgtcgggaccgggccggtaagggtacgggaaggtacggtaggtaagggtacggtaaccgttacgttacgttacgttaccgtaccgtaaccgtaacgtaccgaacgtacgtaacgtaaacttaccgaagaacgtaaaggttaacgtacggttacggggaacggtaaccgggtaacgaccgtacgtaaaccggtcccgtacgtaccggtaccgaccggacccgtaacgccgtaccccggtacccgtccggtaccgtccttccgtcccgttacccctccgttccccgtccg

SEQ ID NO: 70557 - DNA, 709 bp, Homo sapiens
  misc_feature: GYAE6OF02JFWLJ.49.26.C04.1.454.CMB.1.raw
  modified_base (248)..(248): a, c, t, g, unknown or other
  misc_feature (248)..(248): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgngactctcctgtgcagcctctggattcattctttgatgattatgccatgcactggactccgtcaacgccgtccgggggaaggtcgtgggtagtcgggtctcgttacgtttaagtttaagttgggagttgggtaggttacttaccgtaacccttaactagttcggactacgtacccgttgttacgggttaggtaaacggggtccgttaacttcctaaacccgtacttccgtaaccccgtaaggaacgaaaccaaccgtaacggaaccaaacggtaaacccttccccgtagtttaactccgtaagtaacaaagttacgaaaccttagttcctacgtaagggaacgtaggaaccggtaccacccggttacctttactacgttacctggtaacaacggtaaaaacgttcggttaaccgtaccgaaccaaccgttaaccttaggttttcccaaccgtacgtaccggg

SEQ ID NO: 70558 - DNA, 554 bp, Homo sapiens
  misc_feature: GYAE6OF02JT3EE.49.26.C04.1.454.CMB.1.raw
  modified_base (239)..(239): a, c, t, g, unknown or other
  misc_feature (239)..(239): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
  modified_base (512)..(519): a, c, t, g, unknown or other
  misc_feature (512)..(519): n is a, c, g, or t
  modified_base (521)..(530): a, c, t, g, unknown or other
  misc_feature (521)..(530): n is a, c, g, or t
  modified_base (532)..(554): a, c, t, g, unknown or other
  misc_feature (532)..(554): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgctcatctatgacgacaagaaaacgacccctccgggatccctagagagattctctggcctccacctcagggaccagtggcctaacgttgactatcgagccggggcccaggtcggagganggaaggtgacctactattcgttactccaaccagaccaccagtagaaaactcaaccaaggaaggtaagtacgttacgggacggaacgggaaccgaacgacggtacggacccggtcgtaacgggtccaacggacccgtaacggcctccggccccccgtcggtccgtaacccgtccttccgttccccgtcccctcctccgttccctcccgttccgtaaccgtctacgggtacggcccgggtagtcggaaccgnggttaccgcgtaacgcgtgngcnnnnnnnncnnnnnnnnnnannnnnnnnnnnnnnnnnnnnnnn

SEQ ID NO: 70559 - DNA, 852 bp, Homo sapiens
  misc_feature: GYAE6OF02I3O8K.49.26.C04.1.454.CMB.1.raw
  modified_base (550)..(550): a, c, t, g, unknown or other
  misc_feature (550)..(550): n is a, c, g, or t
tcagagtcgagagacacgaccggtgctcgatttagtctagcgactttgggtttggggtgggctcaggaggcagagctctgggaatctcaccatggcctggacccctctcctgcctcccctcctcactttctgcacagtctctgacggcctacctagtcgagtctacgaccacacgtaccctacccgtcgggtcgtccggtccgtccccgaggaacaacggccgagtaacgtaacacgtctacgtcggagtatcgtactactacgtaaaccgtaaaaactaacgtcgtctacggttcgtaaccgaacaaagaacgtacggcggaccggtaccgccgggttagttcgtcctctaagtactacttcggaaccgaaaccgtaacggtaaaacccgggtacccgtacccgggtaccgttaccgtacggaagtaacggttacttacgtcgttaccggtctaccctaccggaccgtacggtaccgtacgtcgtaccgggtacttaacggtacttacgtaccggccggtaaccgggggccgtaacggggtagtacggngtaaacggaggtaccgaagtttactacggtttagtaacctacccgtaaccgaagaaccgtaacgttaacgaacgtaaaccgttacaaacggtaacgggtacgtaacgttaacgggtccggggtaacgggtaacggaaacccgacggtaacggtaccccggttaccgtaacggttaccccggttagaacccgggtccggtaccggttacccccgtccggttaaccccccggtcgtttaacccgttcccggtacccgtttacccccggttaacccccgtttccccgttcccgttaccgtcccgg

SEQ ID NO: 70560 - DNA, 733 bp, Homo sapiens
  misc_feature: GYAE6OF02IFF3B.49.26.C04.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (468)..(468): a, c, t, g, unknown or other
  misc_feature (468)..(468): n is a, c, g, or t
  modified_base (656)..(656): a, c, t, g, unknown or other
  misc_feature (656)..(656): n is a, c, g, or t
  modified_base (720)..(720): a, c, t, g, unknown or other
  misc_feature (720)..(720): n is a, c, g, or t
tcagagtcgagagacacgaccggtgctcgatttagtctagcgactttgggtttggggtgggctcaggaggcagagctctgggaatctcaccatggcctggacccctctcctgcctccccctcctcactttctgcacagtctctgaggcctctatgagctgacacacgccacccgtcggtcgttcggtcgtccccgaggacaaacgggccaggactaacctggctcgtagganagtcgactattagaaccaaaaaaatntacgtcttggttggtaaccaaggtaaagaagtcacgggacctaacgggtccccggtgttcggactctaaacttgaaacgttgaacccgtaacgaacgtaaaaaacccggtcccgaccggacttacccgaggaacgtaggtaacttccgttacgtcgggccttaccacgtaccgacggtaccacgttcggcctaacggtttggaaccttanacgaacgggtccggggaccttagggagaacggtagacggtaagggtcaacttacgtagttacgttaccgtactacccgaagttaccaccggtagttaagaaacctacgtaaacacgaaggtaacctttaagggcgtacgggggaacggtaactaacgtccgacgtaccgtacgtttaacgccggaacncccggtaaggtcctaccggtccccgttaagccccgttaagcccgttacctccccggtttacccncccgttacctcgg

SEQ ID NO: 70561 - DNA, 468 bp, Homo sapiens
  misc_feature: GYAE6OF02H8T7X.49.26.C04.1.454.CMB.1.raw
  modified_base (78)..(78): a, c, t, g, unknown or other
  misc_feature (78)..(78): n is a, c, g, or t
  modified_base (448)..(448): a, c, t, g, unknown or other
  misc_feature (448)..(448): n is a, c, g, or t
  modified_base (450)..(468): a, c, t, g, unknown or other
  misc_feature (450)..(468): n is a, c, g, or t
tcagagtcgagagacacgaccggtgctcgatttagtctagcgactttgggtttggggagatgcattgccaaaaaaatntgcttgttggtaccagaagaagtcaggccaggccccggtgttgctcatctatgacgacagaaaacgaccctccgggatccctgagagattctctggctccacctcgagggaccatcggcccacgttgactagtcgaggccggggcccaggtggaggatggaaggtgactacgtattagtactcgaccagaccacctagtagaaaatcacagaaggaatagtcggacgggaggtaccaagcgtacgacccgtcgtaggtcgacgacccaaggtcctcgccccccgttgggtccacgtcctaccgtttcccaaccccttcctctcctctacgtactcgtgacggtcggctggacgaacggcgtacaatggcngnnnnnnnnnnnnnnnnnnn

SEQ ID NO: 70562 - DNA, 977 bp, Homo sapiens
  misc_feature: GYAE6OF02JURIT.49.26.C04.1.454.CMB.1.raw
  modified_base (655)..(655): a, c, t, g, unknown or other
  misc_feature (655)..(655): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgcttattttaaaggtgtccaggtgtgaagtgcgagttggtggaatcgttgggggagtcgtggtaggaggtccgtgggggtccctggacgtacttcgtaccgtgtcgcacgtcctcgtggtacttcaagtttccgtttgaacgttgtaattctacggcccctagttacgacgtaccgttacggtaccttacccggtactaaaccgggtccgggttacccggggggtaaacggggtttaccgttcggggggttaaccggtttcggggggtttcccttaccgggtttaaccgtttaagtttaaacgggtttaagggggtaaccgtttgggggttaacccggttaacgttaaccccgttaaccgttaaccgtttagtaccgtacggtaaaccgttacgttcggttaagggttaccggggtaacggggtttaaccgttactttccccgaaaccgtctttacccgaaccccgggtaaaggttaacccggaaanaaaacccggtcgggtaaacccgtaaaaccgtaaaaccccctttccgggttaaagttactaaccgggttaacccgtaaagttaaacccgtaacgggttaaaccttaaacccggtaccgttacggtaaaggggtaaccgggggtttacccaaaccggggtaaaccgtccccggttacctttaaccggttaccctttaacgacgggttaaaccggtaaaccggttaaacgggttaaccggttttaacccgggacgttaaaacccggttaccgtttaaaccccgtttttggttaaacccgttaaccccgccgggttaaaccccggg

SEQ ID NO: 70563 - DNA, 702 bp, Homo sapiens
  misc_feature: GYAE6OF02HUUY9.49.26.C04.1.454.CMB.1.raw
  modified_base (243)..(243): a, c, t, g, unknown or other
  misc_feature (243)..(243): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctcggtgtcggtcgtccccaggacaaacggccaggactaacctgctctggagatgcattgaaccaaaaaatntgtcttgttacgtacagaagaagtcacggccaggcccgtgtcgctcatctatgacgaacaacgaaaccgacccgtccggactcccgtaggagagtacttctcgtacgcctccactcgacggtactagtcggacctagttcgactatcgacggccggggaccgtagggcggtaggagtaggaaggtacgtaaccttacgttacgtttcgttaacctaccgaaccgtaacgaaccgttaaccaaggtaaacgaaaacttaccgaacgtaacgggtaagtaaacgttacggtaccggggaacgggtaacggggaaaccctaaggacccggtacggtaacccgttaccgtaaccggtacgaaccggttaacccaacgggttcccgtaccccggtccccggttacggtaccctacccggttccgttcccggtttccccccgtcccctttcccgttcctaccccg

SEQ ID NO: 70564 - DNA, 754 bp, Homo sapiens
  misc_feature: GYAE6OF02IPJPS.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgcttaattttaaaaggtgtccagtgtgaagtgcagttggtggaatcgtggggagtcgtggtagagccgtgggggtccctgagctctccgtgtgcagcctcgtggtattcattctttgattgtattagtcgcctaagtgactacgtggtactccgtaccgaacggtccggtaccgggggtaaggtccgtggggtacggttcgggttacttcgttacgtttaagtttaaggttgggtagttgggttaggttaactaccgtaaccttacgtagtcgtacgtaccgtacttcgttaggtacggtaacgggttccgtaactttaccctaaccgacgtttccctaaccggtaagtaacgaaccgtaaacgacggtaacctaaaccggtaaacccgttcccgttagttaacgtcctaagtaaccctaaagtacgaaacgttcgttaaccgtagtaacgggtaggtaccggaaccggtaccctacccggttacctttaccgtacttaacgttcggtaacgaaaccgtaacggtaccgttaacggaccgtaacctaccgtttaacctttacgtttaccgacccgttagtacccggg

SEQ ID NO: 70565 - DNA, 709 bp, Homo sapiens
  misc_feature: GYAE6OF02FIGGQ.49.26.C04.1.454.CMB.1.raw
  modified_base (240)..(240): a, c, t, g, unknown or other
  misc_feature (240)..(240): n is a, c, g, or t
tcagagtcgagagacacgaccggtgctcgatttagtctagcgactttgggtttggggtgggctcaggaggcagagctctgggaatctcaccatggcctggaccctctcctgctcccctcctcactttctgcacagtctctgaggcctcctatgagctgacacagccacctcggtgtcggtgtccccaggacaaacggccaggactacctgctactggagatgcattagaaccaaaaaatntggactttggttacggtaaccaaggaaacggaacgttaccgagggtaccgtaacgggccccggttgttacggacttcgtaacttccgttaattcggaaccgtaactaacggaaaaaccgtcccctaccggggactccccgtagacggtaacgtaacttccgtaccgtcggaccttaccaccgtacgacggggacctagtcggtaccgtacgtgtacctatcgacggtcggggcccagggtacggacggaagtggaaggtcgaacgtacttaggtacttacgttaccgaaccgagtacgtaccgtaacgttaacggaaacttacgaaccgtaaggaacgggtaactacggttacgggacggtaacggacgaacgctacggtacgtcgtacggttcgacggacctaacgggtcccgtccgaccccgttcggcccgtacgttccgtccgttcccgtcccgtcttacctcccg

SEQ ID NO: 70566 - DNA, 818 bp, Homo sapiens
  misc_feature: GYAE6OF02GQIUI.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtgggggtccctgagactctcctgtgcagcctctggattcattcttgatgattatcgctatgcacgtggtacgtccgtacgacgcggtaccggggtacggtcgtagggacggttgggtctcttactttacgtttaagttaggtagttcgggttaggtactaccgtaaccttaacgtagtacggtacgtaacgtaccgttacgttacgggtaacgggtaaacggggttccgtttaacctacccgtaaaccgttaacttacccgtaaccccgaaagggaaaccgaaaaccaaacgggtacgtaaacccgtaaaaccgtaaccctttaacccgtagttaaccgttcgttaaccgaaaacgtaaaaggttaaccaaacccgttagtttaaccaacggaaacgggttaggggtacggtaaaccgggtaaaccccgtacccccgggttttaccctttaaacccggtacggttttaaccccgttacgggaaaacctttaaaacgggtaaaaaacccggttttacgggttttaccccggtaaacccgttaaacccccgtttaaaacccccgg

SEQ ID NO: 70567 - DNA, 593 bp, Homo sapiens
  misc_feature: GYAE6OF02HNJJ0.49.26.C04.1.454.CMB.1.raw
  modified_base (246)..(246): a, c, t, g, unknown or other
  misc_feature (246)..(246): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (572)..(572): a, c, t, g, unknown or other
  misc_feature (572)..(572): n is a, c, g, or t
  modified_base (585)..(585): a, c, t, g, unknown or other
  misc_feature (585)..(585): n is a, c, g, or t
tcagagtcgagagacacgaccggtgctcgatttagtctagcgactttgggtttgggggagatgcattgccaaaaaaatatgcttgttggtaccagaagaagtcaggccaggccccggtgttgctcatctatgacgacagaaaacgccctccgggatccctgagagattctctggctccacctcgagggaccagtggcctacgttagactatcgacggccggggtcccaggtggaggatggaaggtnactactattgtactaccactagactaaccgataagaaaatcaactaggaacgtaattaacgttccggacgggaagggtaaccaaggcgtacggacccgtccgtagtaccgacgacccgtaaggcctaccggaccccctggtccaacttccgtaccgttaccctaccctctcctctactcgactcgtaggacggccggtgtcgaacgacggctaacgtgaagtncgngtcngcgtgatcgactgcctagtcngtactacacggntancttagacctagctatgacagccttaggaatcctagttccgagtaanacggtntanacgancaagcgtacgtanacggtcta

SEQ ID NO: 70568 - DNA, 784 bp, Homo sapiens
  misc_feature: GYAE6OF02IG1VY.49.26.C04.1.454.CMB.1.raw
  modified_base (252)..(252): a, c, t, g, unknown or other
  misc_feature (252)..(252): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagcccaccctcggtgtcggtcgtccccgaggacaaacggccaggataacctgctcgtggagatgctattacgaaacctaaaaaaagtntgtacgtttgttacggtaaccaaggtaacgaacgtcgacggcccgacgggccccggttagttcgctactatctagtcgacgaacgtaacgaaaaccgtaccccggtccggactccgtagacgtacgtattcctcgtcgctccgaccgtcgacggacctagtccggcctacggtttagacttacgtccgaacgggccggggaccctagggggtcggaacggtagtagggtaaacgggttcgtaaacgttaacgttcgttttacgtaaccgtaccgaaccgtaacgaaacctaaccgtaaggtaaaccgtaaaacgtccctaaacgggaaacggtaaacggtaacgttaaccggttacggggaccgggaaacggggtaaccaacgggtcccgtacggtaaccccgttacgggtaacggtaccggtaaccggaaccccggtaacggtcccttacccggtacccccggttacgtacccgttacccgttcccgtttacccgttacccccggtaccccttcccgtaccctttccccgg

SEQ ID NO: 70569 - DNA, 786 bp, Homo sapiens
  misc_feature: GYAE6OF02GTM8V.49.26.C04.1.454.CMB.1.raw
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagactctcctgtcgcacgtcctcgtaggattcattctttgatgatttangccatgcacgtggactccgtanaacgtccggtaccggggaaggttcgtgggtacgttcggggtccttcgttactttaagtttaagttgggagttgggttaggttaactcctaaccgttatacgtgactacgtacttcgtaggtaggtaacgggttcgtactttaccaaccctacttacccgtaccaagggtaacaaccaaaccgtaggaaccgtaaaccgtaaaccctcccgtttaggttaccttacgtacgtaaactaaaacggttacgtaaaccgttaacgtcgtaaccggaaagggtaccgggttaaaccggaccggtaaaccccgtaccccgtttaccgttaaccgttaccgttaaccggtacgggttaaacgtaaaaaccggtttaaaacggtaaccggttttaacccggtaaaccgtaaccccgttaacttccccggttttttaaaaggtttaccccgaaccccgtttacgggtaaccccgggg

SEQ ID NO: 70570 - DNA, 545 bp, Homo sapiens
  misc_feature: GYAE6OF02GNF5Q.49.26.C04.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
  modified_base (506)..(507): a, c, t, g, unknown or other
  misc_feature (506)..(507): n is a, c, g, or t
  modified_base (509)..(513): a, c, t, g, unknown or other
  misc_feature (509)..(513): n is a, c, g, or t
  modified_base (515)..(523): a, c, t, g, unknown or other
  misc_feature (515)..(523): n is a, c, g, or t
  modified_base (527)..(529): a, c, t, g, unknown or other
  misc_feature (527)..(529): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (544)..(545): a, c, t, g, unknown or other
  misc_feature (544)..(545): n is a, c, g, or t
tcagagtcgagagacacgaccggtgctcgatttagtctagcgactttgggtttgggggagatgcattgccaaaaaaatatgcttgttggtaccagaagaagtcaggccaggccccggtgttgctcatctatgacgacagaaaacgccctcgggatccctggagagattctctggcctccacctcgaggggacccagtcggaccctagttcgactagtcaggccggggacccagggtggacggatggaaggtnactactattgttacncaccagacaccgagtacgaaatcacagaggaattagtcggcggacggacaaggctcgaccgtcgtaggtcacgcccgaaggctacgtccccgtgtacctcgtcctccgtaccccgtccctacccttcgtcctaccgttccgaccttcgttcggaacgggtccgggtcggttaccggacggaaacgggtccgacgtaacgtaggcgagtcgngctncgtcngctnacgtngncngtananncnnnnncnnnnnnnnnacgnnncnagngcncncnncnn

SEQ ID NO: 70571 - DNA, 686 bp, Homo sapiens
  misc_feature: GYAE6OF02IACSE.49.26.C04.1.454.CMB.1.raw
tcagagtcgagagacacgaccggtgctcgatttagtctagcgactttgggtttggggggaagagaagactgacggtccccccaggagttcaggtgctgggcacggtgggcatgtgtgagttttgtcacaagatttgggctcaactctcttgtccaccttggtgttgctgagcttgggttttccttgttgctattttaaaggtgtccagtgtgaagtgctagttggtggatcgtgggggagtcggtggtagagccggtgggggtccctggagactctcctgtgcagctcgtgacttcattcttgatgtatttagtgacctagtgacctacgtggtactccgtacgacggtccgggtacggggtacggtcgtggggtaggtcggtccttcgttatttaacgttaggtggtagtcggttagtactcgtaaccttagtactacgacgtacgtacgtcgttagggtacgggtaacggttctacttaccctactacgttaccgacgaaagaccgtaaacacgtaacgaaccgtaaacaaccctctacgttactacgtacacgaagtacgtaagtacctacgaagacgggtacgacggaaccgtaccgtaacccgttccctttacgaccgttaccgtagtaaccggaaacgttaaaccggtaaccgggtttacaacccgtacccttaacccgg

SEQ ID NO: 70572 - DNA, 751 bp, Homo sapiens
  misc_feature: GYAE6OF02FVVZH.49.26.C04.1.454.CMB.1.raw
  modified_base (232)..(232): a, c, t, g, unknown or other
  misc_feature (232)..(232): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgcttattttaaaaggtgtccagtgtgaagtgcagttggtggaatcgtgggggagtcggtggtagngccgtcggggggtcctgagactctcctgtgcacgcctcgtggattcattctttgatgtatttatcgacctatgcctagtggtacttcccgtacgaacggtccggtaccggggtaagggtcggtagggtacggttggggtcctttcgttacgttttaagttaaggttagggtacgttgggtttacgtacttacctaaccttaacttgtagacgtacgtacttcgttagggtaacggtaacgggttcgtaacgtttaccctaaccgtacttaccgtaccgaaggaaccgtaccaaacgacgaccgtaaacgtaacccttccgtacgttactccgtaggaaactaaagttacgaaacgtacgttactaacggtaggtacgggtaacgggaccgtaacccgtcccggttacctttaccgtaccttaccgttagggtaactaaaccgttaaaagtaaccggtttaacggtaccctaacccgtaacgttacccgtttaagtttcccggacccgtaccggtaccgg

SEQ ID NO: 70573 - DNA, 619 bp, Homo sapiens
  misc_feature: GYAE6OF02IC146.49.26.C04.1.454.CMB.1.raw
  modified_base (289)..(289): a, c, t, g, unknown or other
  misc_feature (289)..(289): n is a, c, g, or t
  modified_base (424)..(424): a, c, t, g, unknown or other
  misc_feature (424)..(424): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctatttaaaggtgtccagtgtgagtgcagtggtggatcgtggggagtcgtggtagagccgtgggggtccctgaggactctcctgtgtcacgcctcgtggattcgattctttgaatgtattntcgtcatgacactggatcccgtagaacgccgtaccgggaggtctggagtgggtctcttcgttattaagtgggtatgggtagttactccacgttatagttcgactacgactctaggtacgaggggtctattccacncgtacgtcaagtgaacactagcaagaacctccgtanacgtntgacaactaagaaccgtaagtccacgtaagtaggacgacggtacaacccgtttcctacttacccgtcttccggtaagaacccgtaaaagttcgtaaccggtcggtaacccaaccgttacccgttaagttttaccgacccctagttaccccgggg

SEQ ID NO: 70574 - DNA, 611 bp, Homo sapiens
  misc_feature: GYAE6OF02F6F1O.49.26.C04.1.454.CMB.1.raw
  modified_base (383)..(383): a, c, t, g, unknown or other
  misc_feature (383)..(383): n is a, c, g, or t
  modified_base (494)..(494): a, c, t, g, unknown or other
  misc_feature (494)..(494): n is a, c, g, or t
  modified_base (579)..(579): a, c, t, g, unknown or other
  misc_feature (579)..(579): n is a, c, g, or t
  modified_base (603)..(603): a, c, t, g, unknown or other
  misc_feature (603)..(603): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtggggagtcgtggtagagccgtggggggtccctgagactctcctgtgcacgcctctggattcattctttgatgtattatgccatgcacgtgactccgtacaagccgtaccggggaaggtctagggagtgggtctcttacttattaagtggattggtgtactcacctactancgctacgactgtagtaggaacgggtcgtactcaccgattccgacgaagacgtaaccaacgaagaacgaagtaaacccttccgtattaacgttctagaactaaagtctaaancgttacacgtaaggaggttacgacgactaacccgtcttaccgtatacgtagtaacgaaaccaaagggtacttacggactaacccngttaaccctttaggtaccgaaccngtacccgg

SEQ ID NO: 70575 - DNA, 727 bp, Homo sapiens
  misc_feature: GYAE6OF02I8LA9.49.26.C04.1.454.CMB.1.raw
  modified_base (134)..(134): a, c, t, g, unknown or other
  misc_feature (134)..(134): n is a, c, g, or t
  modified_base (437)..(437): a, c, t, g, unknown or other
  misc_feature (437)..(437): n is a, c, g, or t
  modified_base (558)..(558): a, c, t, g, unknown or other
  misc_feature (558)..(558): n is a, c, g, or t
tcagagtcgagagacacgaccggtgctcgatttagtctagcgactttgggtttggggtgggctcaggaggcagagctctgggaatctcaccatggcctggacccctctcctgcctccccctcctctactttctncacagtctctgacggcctcctatgagctagaccacacgcccacccgtcggtgtcggtcgtacccgaggacaacggccaggactaacctgctcgtgagatgactatacgaaacctaaaaaatgtacgtcttaggttacggtaaccaaggtaaagaacgtacgaacggacccgaacgggtcccccggtagttcgacctactacgtacctaagtacgtaaccgaacaaaccggtaaaacccgtaccccgtaccgggacctaccgtgacgagtactcgtacgtcgacctcctaccgagaccggactnccggactagtcaacgtacgacgcgggaccggtcgtagggcggaacgtgtacggaagttcgaaccgtaagtttacgttacgtaacctaccgaacgtaacacgaaacgtaagtaacgtaaacnccgtaaagaacggtaagtaacggttggtaccgggacggtaacgggaaccgtagtcccgttaccgtaacgttaccgtacggtacaccggaaccgtcggtaccctcccgggtcccccgtatacccgtccgtttacccggcccttacccccgtacccttccgttcctacccg

SEQ ID NO: 70576 - DNA, 729 bp, Homo sapiens
  misc_feature: GYAE6OF02IJ5YI.49.26.C04.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
tcagagtcgagagacacgaccggtgctcgatttagtctagcgactttgggtttggggtgggctcaggaggcagagctctgggaatctcaccatggcctcggaccctctccgtgctcccctctcactttctgcacagtctctgcggcctacctatgcgctagaccacacgcccacccgtcggtgtcgtcgtaccccgaggacaaacggccaggactaacctgctgaggaantgctatcaacaaaaaatgtntcgttagttgaaccagaaagtagacgaacggccgtacggtccccgtgttcgcactntcgtatacgacgaactaagaaaccgtaccgaccggactaccgagaggtanacttcgtcgtcggtccacctacctacgacgggaacctggcgaccgtagttacgacttacgcgacgggcggacccggtagggacggaacggtagtacgggaaacggtacgtaaccggttaacttacggttacggtttaacaaccgttacgtaaaccaaccgggaacctaaacgggtaaacgtaaaaccggttacaaacggtaaagggaaacggttaaaaccgtggttacccggggaacggaacgggaaccctaggtaaacctcggaaaccgttcgaaccgtacgaccggaccgtaacggcccgtttaccggaccccggttaccgaacgtaccgttacccgtcgttacccccgtaaccccttcggttccctcccg

SEQ ID NO: 70577 - DNA, 799 bp, Homo sapiens
  misc_feature: GYAE6OF02FQL00.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctattttaaaaggtgtccagtgtgaagtgcagttggtggaatcgtgggggagtcgtggtagagccgtggggggtccctggagactctcctgtgcagcctcgtggattcattctttgattgattatggccctagtcgctacgtggtactcccgtacgaacggtccggtaccgggggtaagggttcgtaggggtacggttacggggttccttacgttacgtttaagttttaaacgtttggggtaacggtttgggttacgggttaacttccgtaaccttaaccgttagttacggaccgtaagtaccgtttccgtagggttacgggtaacggggttacccgttaattacccgtaaacccgtacttcccgttaacccggaaacgggaaacgtaaccccgtaaaacgtcgggaaacccaaacgggttaaaacccctttcccggtaagtttaactccgtaacggtacctaaaagttccgaaacgttacgttaaccgtccgtagggacgggttagaaccggtacccgaacccgtttacccgttaacgttaacccgttacggttagtaacctaaacggaaacgtttaaccggtttacccgggtacaacccgttaacccg

SEQ ID NO: 70578 - DNA, 762 bp, Homo sapiens
  misc_feature: GYAE6OF02HE4WM.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttggggctgagcttgggttttccttgttgcttatttaaaaggtgtccagtgtgaagtgctagttggtggaatcgtggggagtcggtggtagagccgtcggggggtccctggagactctctgtcgcagcctcgtggtattctatttctttgtatgtaattagtcgcctagtcgacctacgtggtactacccgtacgaacgggtcccggtaccggggggtaagggtcggtaggggtacgggttcggggtaccttccgtttaacgtttaacgttttaagggttacggggtaggttgggttagggttaactacccgttaaacctttaacgtagtacgacgtaaccgtacgttacgttagggtacgggtaacggggttacgttaaccttcccgtaacctactacccgtaaccgaggtaacgaaaccaaacgtagaacctaaaccggtaaacccttccctaaggttacaccgttacgaaacaaacgttaccaaagtacgttacgtacggaaggtacggtaccggaagtaccccgtaccgtaccttaccctacttaggtacgtaacgaactaaaggtacgtacggtaccaaccttacgtaccttactttaccgaccctaggtaccggg

SEQ ID NO: 70579 - DNA, 636 bp, Homo sapiens
  misc_feature: GYAE6OF02GEWRF.49.26.C04.1.454.CMB.1.raw
  modified_base (292)..(292): a, c, t, g, unknown or other
  misc_feature (292)..(292): n is a, c, g, or t
tcagagtcgagagacacgaccggtgctcgatttagtctagcgactttgggtttgggggggaaggaggaagactgacggtccccccaggagttcaggtgctgggcacggtgggcatgtgtgagttttgtcacagatttgggctcaactctcttgtccaccttggtgttgctgagctgggttttccttgttgctattttaaaaggtgtcctagtgtgaagtgctaggttggtggaattcggtgggggagtcgtggtagagccggtcgggggtcctggacgactctcctgtcgcngcctgtggtattcattcttgtactgttattagtcgacgtatcgactacggtgtaccgtccgtacaacggccgggttaccgggggaagggttcggtagggtacggtcgggttactcgttacttagtttacgtggtagtggtagtactcactactagcgacagtctcgtgtaggtaggtacgtactcacactcactagaacacacgacgacaacgtacctccgtagtactacgtacgaactagtaacgaactatacgtacagggtcgtagaccgaccgtacctacccgttacgtacgtacgtacggtacaacggtaaaacttggtaacccgtacgaacctaacccg

SEQ ID NO: 70580 - DNA, 882 bp, Homo sapiens
  misc_feature: GYAE6OF02G1TGD.49.26.C04.1.454.CMB.1.raw
  modified_base (801)..(801): a, c, t, g, unknown or other
  misc_feature (801)..(801): n is a, c, g, or t
  modified_base (843)..(843): a, c, t, g, unknown or other
  misc_feature (843)..(843): n is a, c, g, or t
tcagagtcgagagacacgaccggtgctcgatttagtctagcgactttgggtttgggggctctgggaaaggagcccagcctgagattcccaggtgtttccattcggtgatcagcactgaacacagaactcaccatggagtttgggctgagtcttgggttttaccttgttgcttaattttaaaaggtgtccaagtgtgaagttgcagttggtaggaatcgtggggagttcgtggtagtacggtccgtggggggttacctggacgtaccgttcctcccgttgttcggaccaggacccttcgtacgggtaaccgtttcaactttacgttttagacgtttaggaacgttttaacgccgtaccgtaacggttcggttacccgtaacccggttacggggttaacccgtcccggttaaccgggtaaacggtcccgggtttaccccgggggggttaaagggttcccggttaaggggttaaccggggtttacggggtttcccgtttaccgttttaccggtttttaaaccggtttaaggttttaggggaacggttttcggggttaacgggtttaaacgtccccggttaccgtttaaacctttaggacggggttaccgaaccggtttacctttacgggttacgttaaggggtaaccgggttacgtaacggttttaaccaccgtagtaccttaccggaagtaccgtaacgactaggactaaccggttaacttcccgagttcgtactagaaccgtaaatctaaacccgtgacgtcgtaaggcggttacgaacgtcccggtaaattccgtagttanaccgtttaggcctaaaggttacgtaacgttacgacccgtaanacccgggtttaattaacggttcaacccggtagtcccggg

SEQ ID NO: 70581 - DNA, 792 bp, Homo sapiens
  misc_feature: GYAE6OF02J0HR9.49.26.C04.1.454.CMB.1.raw
  modified_base (186)..(186): a, c, t, g, unknown or other
  misc_feature (186)..(186): n is a, c, g, or t
  modified_base (226)..(226): a, c, t, g, unknown or other
  misc_feature (226)..(226): n is a, c, g, or t
tcagagtcgagagacacgaccggtgctcgatttagtctagcgactttgggtttgggggtgggctcaggaggcagagctctgggaatctcaccatggcctggaccctctcctcgctccccctcctctactttctgcacagtctctgaggcctcctatgagctgacacacgccacctcggtgtcggtntcccgagacgaacggccgaggactactgactcgtggagangctattacgaaccaaaactaatatgtacttacgtacggtacagacagacggaccgaggtccgaccggtcccgtgtcgttaggtacgttatttaaacgtaaggttacgtttaggaacggaccggtacccgtccggtaacggtaccccgtaggacgtacgtaccttcgtacgtacggcctacgcgtcgtaacggacggtaaccaacgtacgtaccgtaaccttacgaaccagtcgtacggtacgggtaaccggtcccgggaacgtaacgggacggtaacggacggtccgtaacgtaacttaccgttaactcggttaaccgaccggttaaccgacgtacgacgtacgggtaccgtagggtacgtacggttacgttacgttacggtcgttaaccggggtacgggcgggtaaccggacgttaacccggtacggttaccggttaccggttaaccgggttccggaaccgttacccggtaaacccggttaccggtacccgggttacccccggttaccgggtccccggtttaacccggttcccgtttaacccccgggttccgtttccccccccgg

SEQ ID NO: 70582 - DNA, 878 bp, Homo sapiens
  misc_feature: GYAE6OF02FZZ3I.49.26.C04.1.454.CMB.1.raw
  modified_base (242)..(242): a, c, t, g, unknown or other
  misc_feature (242)..(242): n is a, c, g, or t
tcagagtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagcccaccctcggtgtcggtgtccccaggacaacggccaggactaacctgatctggagatgcattgaccaaaaaatntgcttgtggtaccagaagaagtcaggccaggccccggtgttcgctctatctatgacgacagaaaaccgaccctaccgggactccctagagagacttctcgtggctcccactcgtagggaccagtcggaccgacgttgactactacgacgggcccgggggtacccgaggggtacgggaggggtaacgtggggaaagggtacggaactttaacgttaacgtttacggttacctttaaccaacccggtaacgaaacccgtaacccgtaaacggttaaggtaaaaaaacccgttacccgaaaccgtaaacgggaaacgggttaaaacggttaaaccgggtttttaccgggggaaaccgggggttaaaccgggggaaaccccggttaaaaacggggttaccccgttaaacggggttaaacccccgggtttaaccccggttaaaacgggggtttaccccgtaaacccggggtaaccccccggtaaaaccgggggttacccccggttaccccgggttaaccccccccccgggttttccccggggttaaccccgttaaaccccgtttcccggtttaccccccgggtttaccccccccgggtttaccccccttttaccccccgtttccccgttttaaccccccgg

SEQ ID NO: 70583 - DNA, 803 bp, Homo sapiens
  misc_feature: GYAE6OF02F2OQN.49.26.C04.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacacgtctctgaggcctcctatgagctgacacagccacccgtcggtgtcggtcgtcccaggacaaacggccaaggataacctcgactcgtaggagatcgntattcgaaacctaaaaaaatntacgtacgttagttacggttaaccaagaacgtaaagtccgaggacccgaacgggtcccccgggtagttcggtaaccttctaagtccttaagttacggtaaccggtaaaccaaaacggtaaaaaacccgtaccccccggtaccggggaaccttaccccgtaggtaaacgtagtacgtttacttcgtacggtacccttaccctaccttaccgaacggggacctaagtcggtaacctacgtttaagggaacttaacgtacgaccggggaccggggtaccctaaggggggttagaagggtaacgtaaggtaacgggttagtaacgttaaacgttagtttcgtaacccttacgaacccaaacggaacctaacgaaacgtacaaaaacgtcaaacggtaacgaaaggtaacttaacggtagggacggaaaccgggaacaagtccgtacggacccgtagtaacgcgtaacgaccggaagaccggcccgttacccgttccggtaaccttccgttaccggttacccctacccccgtacccttccgttacccttacccg

SEQ ID NO: 70584 - DNA, 747 bp, Homo sapiens
  misc_feature: GYAE6OF02IV4TP.49.26.C04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgacggcctcctatgagctgacacacgccctaccctcggtgtcggtcgtccccgaggacaaacggccaggactaacctgctcgtgganatgctattacgaaaccaaaaaatnttcgtacgttttggttacggtaacctaaggaaagtaacgtcgacggccaacgggtcccccggtgttcgctcattctagtgacgaacaacgaaaaccggtcccgtccgggtacctccgtaggacgtagtcttacgtcgtcggtcctaccaccgttacgacggacctgtaccggctacgttcaactacgtcggacggtccgggacccgtagggtcgggaggtacgtagggaacgtacgtaacttaccgttgtttaccgttacaccgtaacccgacgtaaccgtacaaggttaaacgaaacctcgaacgtaacgggaagtaacggttacgtaaccggggtacggaaccgggtaacctaacggccgttacgtacccggttaccgttacgacccgtacggtaaccccgaaggtcccccgtacggtccccccgttagaccccgtttaacctcccggtttacccttaacccccccggtccctttccgttcccttaccccgg

SEQ ID NO: 70585 - DNA, 793 bp, Homo sapiens
  misc_feature: GYAE6OF02JOG9D.49.26.C04.1.454.CMB.1.raw
  modified_base (182)..(182): a, c, t, g, unknown or other
  misc_feature (182)..(182): n is a, c, g, or t
  modified_base (631)..(631): a, c, t, g, unknown or other
  misc_feature (631)..(631): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagttgggctgagctgggtttccttgttgcttaattttaaaggtntccagttgtgaagtgctaggttggtggaatcggtagggggtagtcggtgggtagaggtccggtggggggtccctggacgtactccgtcgtgtcgcgacgtcctgtggtacttctattcgttagatgtattctcgcctatcgactacggtggacgttcccgtagtaaccgggtaccgggtaccggggggtaaggttccggtagggtcgggtttgggttacccttacgtttaacgttttaacgttaagggttggggtacgttagggttcggttaccttaaccggtacctttagttacgtacgtccgttaaacggtaccgtttcgtacgggttaggtaaccggggtttcctaactttacccgacgttactaccgtaccgaagtacgtacaagtacgaactaacggtaaccttcgttactacgcgtactaagaacgttaacgagttacccgtntaacggaccgggtaggaacccgacgggtaccctacccgggttattcccgttaacgttacggtgaaacccggttaaacggtaaaccgttaccggttaacccggaccgtaccccggtaaacttttccgttaacccgtaccgacccggttacgttaaccccgggg

SEQ ID NO: 70586 - DNA, 860 bp, Homo sapiens
  misc_feature: GYAE6OF02JVXHP.49.26.C04.1.454.CMB.1.raw
  modified_base (305)..(305): a, c, t, g, unknown or other
  misc_feature (305)..(305): n is a, c, g, or t
  modified_base (828)..(828): a, c, t, g, unknown or other
  misc_feature (828)..(828): n is a, c, g, or t
tcagagtcgagagacacgaccggtgctcgatttagtctagcgactttgggtttgggggctctgggaaaggagccccagccctgagattccccaggtgtttccattcggtgatcagcactgaacacagaactcaccatggagtttgggctgagtcgttgggttttccttgttgtacttaagttttaaaaggtgtccagtgtagaagtgcgtagttggtggaatcgtgggggagtcggtggtagacggtccggtgggggtccctggacgtactccgtcctgtcgccacgtcctcgtggtacttcgtntttcgttagattagttattatcgtacctatcggacctacgtaggtaacttcccggtaacgtacgggtaccggggtaccgggggtaacgggtcggtaggggtacggttacgggttcccgttacgtttaaccgtttaaggttttaaggttaggggtaggttagggttacggttaacctaccgttaaccgttacgttaacggtacgtaaccgtaacgttaccgttacgggttacggtaacgggtttaacgggttacgttaccgttaccgtaacccgtttacttacccggaaccgtaaacgaacgttaaaacccgaacgaaccggtaaccgtaaaacccggttacccttaccgtttaggtaacttaaccgtacgaaaaacctttaaggaaccgttaaccggtcgttaacgtaaaccggggtggtaacccgggtaaggaacccgtccccgtaaccgtttccttaaaccgccgtttagtaaccgtaaacggtaaccgtaaagttccgaaacccgttacgaaccctttanaccgttttaacgcctaacccgtccggtaacgg

SEQ ID NO: 70587 - DNA, 683 bp, Homo sapiens
  misc_feature: GYAE6OF02FT74A.49.26.C04.1.454.CMB.1.raw
  modified_base (247)..(247): a, c, t, g, unknown or other
  misc_feature (247)..(247): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
tcagagtcgagagacacgaccggtgctcgatttagtctagcgactttgggtttgggggtggggctcaggaggcagagctctgggaatctcaccatggcctggacccctctcctgctccccctcctcactttctgcacagtctctgaggcctcctatgagctgacacagccaccctcggtgtcggtcgtccccaggacaaacggccagataacctgctctggagatgcagttacgaaccaaaaaattntgtactttaggttcggtaccaaggaagaagtcacggaccacgggccccggttagttcgctcattcgtatagacggacaacggaaaccgaccccgtccgggactccccgtagacgagtctttacgtcgtcggctacccaccgttccgaacgggaccctgtccggaccgtacgttacgtaacgtagtaccggcgggcccggggacccgaggggtagggtacggagtacggggtaagtacgtaaccttacgttatttacgtcctaaccaccgacgaacctacgaacgtaanaanacacggaagaggtaatcggttcggggagggacggaaccgtagcttacggccgttacgtacggtacacccgaccgaacgggtccctcccggtccccgtcggttcctaccgtcccggttcccgttccccgcccgttccctcttcccg

SEQ ID NO: 70588 - DNA, 969 bp, Homo sapiens
  misc_feature: GYAE6OF02ICJF0.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggtttccttgttgctatttaaaggtgtccagtgtgaagtgcagttggtggaatcgtggggagtcgtgggtagaggccgtggggggtccctggagactctccgtgtgcagcctcgtggtacttcattctttagtatggtattatcggcctattcggactacgttcggactcccgttaccgaaacggtccggtaccgggggtaaacgggttcgtacgggtacgggttcggggttccctcgtttacctttaaggttaaaggtttggggtacgttagggttagggttactaccggtaaccttacgttacgttcggaccgtaagtacctttacggttacgggttagggtaaaccggggtttccgtaacgttttacccgaacctaacgtttccccgttaaccgaacgggtaacaaaccgaaacaacgggtaccctaaaaacgttaaccccgttcccgttaacgtttaacgtacccgttaaaggtaacctaaaaaccgggtttacgaaaccccgtttaacggttaccgtaaccgggttaagggtaaaaccgggtttcccggggaaaacggggtaaccccccgttaaaccccgggttttaaccccgtttttaaccgtaaccccggttttaacccgggtttacggtttaaaacccggaaaaacccgggttttaaaacccggttaaaccggggtttttaaacccccgggaaccccggtttaaacccccgtaaaaccccggtttttaaaccccggtttttttaaaaccccgggttttttacccggaaaaccccccggttaacccgggttttaaacccccgggggg

SEQ ID NO: 70589 - DNA, 704 bp, Homo sapiens
  misc_feature: GYAE6OF02FXKUF.49.26.C04.1.454.CMB.1.raw
  modified_base (290)..(290): a, c, t, g, unknown or other
  misc_feature (290)..(290): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtggggggtccctgagacctctcctgtgcagcctctggattcattcttgatgattangccatgctacgtggactccggtacacggcgtaccgggggtaaggtcgtagggacggtcgggttcctcgttctttaagttaagttgggtagttgggtaggttatacctaccttactagtcgacgtaatcgtcttggtaggtacgggtacgtacttaccgacctacgtacctacgaaagacgaaacccgaaacgacgactaaaacgtaacccttcgtagttacttacgtacgtaaacctaaagtacggtaaactaggtaccgttaccggaagggttaagggtacggaaaccggtccccgtaaccgttcccgtttaacctacgttacgtagggtaaacaacgttaaacggtacgtttaaccggtaaccgacccttaacgttacctttaacggtttaccgaccgttacggtacccggg

SEQ ID NO: 70590 - DNA, 758 bp, Homo sapiens
  misc_feature: GYAE6OF02FWJUH.49.26.C04.1.454.CMB.1.raw
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (571)..(571): a, c, t, g, unknown or other
  misc_feature (571)..(571): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccaccctggtgtcggtcgtccccgaggacaaacggccaggataacctgctctggagatgcattacgaacctaaaaatntgtcttggttacgtaaccaagaaggaagtcgaggaccgacgggtaccccggtgttcgctnactctanacgacgaacgaaggaaaacccgtacccggtaccgggtaactccccgtaggaacggtacgtactttaccgtcgttcggggcccttaccgacccttacggaacggtaccgtagtccggtacctacggttagaccttacgtacgacggggacccggggtaccgagggtgggaacggtacgtagggtaacggttcgtaacctttacctttaaggtttaccgttaacctacccgtaaccgaacgaaccctacgtaaccgggtaanaaaacgtccgaacgtaaggaaaggtttaagtaccgggtttacggggaccgggtaaacggaaccgtaacgggtcctaacggtcccgttaacggtacgtaccgaccggtaccgaacggtccctaccggtccccgttacggtcccacgtttacccgtcccttaacccctcccgttaccgtcccttacccg

SEQ ID NO: 70591 - DNA, 681 bp, Homo sapiens
  misc_feature: GYAE6OF02GD5G7.49.26.C04.1.454.CMB.1.raw
  modified_base (181)..(182): a, c, t, g, unknown or other
  misc_feature (181)..(182): n is a, c, g, or t
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
tcagagtcgagagacacgaccggtgctcgatttagtctagcgacttttgggtttgggggctctgggaaaggagcccccagccctgagattcccaggtgtttccattcggtgatcagcactgaacacagaactcaccatggagtttgggctgagcggtcgttcgtgtaggctattaaagtgnngtntgatgnagtgngatcgtggatgngngancgtggggtacctgagactctctganccagcctntgtatcagttcgttagactgtaactgctacgagtccanagtggacgtaccggataggtaccggtcggggaggttatgggagttacccggtnttacgttacgttaatgggtgtaccgtaggtagtactagtaacttcgtacgtcgtagtactgtaggtacgtaggacgttacgacttaccgtatacgtacaccaaaggacgtaactaaacgaccgtaacgtaacgtaacccgtacgttaacgtaaccgttactaacgtaaactaaacgtacgtaacgtaccgtacggtacgtaaggtacggtaccggtaacccgttaacccggtaccttaccgttacgtacgttacgtaagtaaccgtaaacgtaaccggttaacgtaaccgtaccgttaacccttacggtttaaccctttaacgtacttacccgtacgtacccgg

SEQ ID NO: 70592 - DNA, 750 bp, Homo sapiens
  misc_feature: GYAE6OF02HLAGZ.49.26.C04.1.454.CMB.1.raw
  modified_base (535)..(535): a, c, t, g, unknown or other
  misc_feature (535)..(535): n is a, c, g, or t
tcagagtcgagagacacgaccggtgctcgatttagtctagcgactttgggtttgggggaagaggaagactgacggtcccccaggagttcaggtgctgggcacggtgggcatgtgtgagttttgtcacaagatttgggctcaactctcttgtccaccttggtgttgctgagctgggttttccttgttgctatttaaaaggtgtccagtgtgaagtgcagttggtggaatctgggggagtcgtggtagagcctgggggtccctgagactctcctgtgcacgtcctctggattcattctttgatgattatcgccatcgctactggactccggtacaacggtcgtaccgggggaagggttcgtagggtaggttcgggttctcttacttaagtttaagttcggggtattagggttaggttactaccgtaacccttaagtacgtacggctaacggtacttcgttaacgggtaggtaaacggggtttaccaagtttacccaaccgtaacttcccgtaaccgaacggtaccgaacctaaaacncgggaacctaacgtaaaacccgtttcccgttaagttaaacccgttcgtaacggtaacctaaaacgttccgaaaaccgtcgttacctaagtacggtaaggggtaccgaacgggtaaccccgtaaccgttacccgtttaccgttaacgttaccgttacgggtaacgtaaacccgtaaaaagttccggtttaaccgggttaccgaaccccttaaaccg

SEQ ID NO: 70593 - DNA, 823 bp, Homo sapiens
  misc_feature: GYAE6OF02HFBI4.49.26.C04.1.454.CMB.1.raw
tcagagtcgagagacacgaccggtgctcgatttagtctagcgactttgggtttggggtgggctcaggaggcagagctctgggaatctcaccatggcctggacccctctcctgcctccccctcctctactttctgcacacgtctctgaggcctactagtgacgctgacacacgccctacccgtcggtgtccggtcgtccccgaggaaccaaaaccggccgaaggaactaacctggcctcgtagggatagtcgactattacgaaaacctaaaaaattgtcgtacgttaggttaggtaaccaagaaacgtaagtccgacggaccgacgggccccgttagtagcctatactctagtacgacgtaaccgaacgaaaaacccgtccccgtaccgggtactacccgtagacgtagtacttcgtaccgtcggtaccctaccgtaaccctacggaacgggtacctcgtaacggtaccctacggttacggaaccttaacgaccggtaacggggcccggggaccggtaacggggtacgggtaacgggtaagtaggggtaaacggttaacggaaacccttttacgtttaaaccgtttaccgggtaacttaaccccgaagaaccgtaaccctaacggtaaacgttaaccgaaaacctaccgaaggtaaacgtaacgggtaattaaccgggtcgggaaaccggggtacgaaaccgtccgttacgtaaccggaaccgttaccggtaccgacgacccggaaccgtcggacccgttcccgtcccggttacgaccttaccgttacccggtccctacccctaacccgttccctacttcccgg

SEQ ID NO: 70594 - DNA, 745 bp, Homo sapiens
  misc_feature: GYAE6OF02IT6WP.49.26.C04.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (255)..(255): a, c, t, g, unknown or other
  misc_feature (255)..(255): n is a, c, g, or t
  modified_base (412)..(412): a, c, t, g, unknown or other
  misc_feature (412)..(412): n is a, c, g, or t
  modified_base (573)..(573): a, c, t, g, unknown or other
  misc_feature (573)..(573): n is a, c, g, or t
  modified_base (628)..(628): a, c, t, g, unknown or other
  misc_feature (628)..(628): n is a, c, g, or t
tcagagtcgagagacacgaccggtgctcgatttagtctagcgactttgggtttgggggtgggctcaggaggcagagctctgggaatctcaccatggcctggaccctctctgctcccctctcactttctgcacagtctctgaggcctcctatgagctgacacacgccacccgtcggtgtcggtcgtcccagacgaaacggcaggactaacctnctcgtggagatgactattacgaaaccaaaaaaattntacggtntttaggttacggtaaccaagaacgtaagtcgaaggtacccgaccgggtccccggttagttcgtctcgtattctagtaggaccgtaaacgaaacgaaaaccgtccccggtaccgggtacctacccgtaggaagtaacgtactttcctcgtccgtaccncccgtaacccgtcggaaccggtaccgaggttacggccttacgttacgaacgttactacgaccgggaccgggcccggtagggtcgggaagttaggacggtaaaggtacgaaacgttacgttagtttagtacctaccgacaaacggtacctaacaaggttaanaaacgtagtaacggaaagaacgggtaactacggttacgggaacggtaccgggaanaccgggttacacggtacccgtaggtacggaccgtaaccgaccggaaccgttccgtaccccggtccgttaccgtacctccgtaccgttcccgttacccacccgtttcccacgttcccg

SEQ ID NO: 70595 - DNA, 737 bp, Homo sapiens
  misc_feature: GYAE6OF02F7AFD.49.26.C04.1.454.CMB.1.raw
  modified_base (183)..(183): a, c, t, g, unknown or other
  misc_feature (183)..(183): n is a, c, g, or t
  modified_base (228)..(228): a, c, t, g, unknown or other
  misc_feature (228)..(228): n is a, c, g, or t
  modified_base (295)..(295): a, c, t, g, unknown or other
  misc_feature (295)..(295): n is a, c, g, or t
  modified_base (549)..(549): a, c, t, g, unknown or other
  misc_feature (549)..(549): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagttgggctgagctgggttttccttgttgcttaattttaaaggtntccagtgtgagtgcaggttggtgaatcgtggggagtcgtggtagngccgtggggggtccctgagactctcctgtgcacgcctgtggtacttcattctttagatgtaacttancgcctatcgctacgtcgactccgtacgaacggtccggaccggggtaggtcggtagggtcggtcgggtcttcgttactttaagttaaggttgggagttggttacgtactacctaacccttagttcgtcgtactaacgtacttcggtaggtaaggtacggttcgtacgtacccacttactcgtaccaaggtacaaccaacacgaacctaacgtaacccttccgtagttactcgtaacgtaactaagtaccgtaacnccgttactaacggaggttacgggaccgtaacggaaccccgttacccgtaacccttaccttaaccggtaccgttagggtaaacctaaaaccggttaaacggttaacccgtttaccggtaacccgtaaccctttaaccgtttaaccccgtttaaggtttaacccccgaccgtttacccgggaaccccggg

SEQ ID NO: 70596 - DNA, 586 bp, Homo sapiens
  misc_feature: GYAE6OF02HODCN.49.26.C04.1.454.CMB.1.raw
  modified_base (78)..(78): a, c, t, g, unknown or other
  misc_feature (78)..(78): n is a, c, g, or t
  modified_base (238)..(238): a, c, t, g, unknown or other
  misc_feature (238)..(238): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (326)..(326): a, c, t, g, unknown or other
  misc_feature (326)..(326): n is a, c, g, or t
  modified_base (448)..(448): a, c, t, g, unknown or other
  misc_feature (448)..(448): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (504)..(504): a, c, t, g, unknown or other
  misc_feature (504)..(504): n is a, c, g, or t
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (562)..(562): a, c, t, g, unknown or other
  misc_feature (562)..(562): n is a, c, g, or t
tcagagtcgagagacacgaccggtgctcgatttagtctagcgactttggggtttggggagatgcattgccaaaaaatntgcttgttggtaccagaagaagtcaggccaggccccggtgttgctcatctatgacgacagaaacgccctcgggatccctgagagattctctggcctccacctcgagggaccagtcggcctacggttgacgtatcaggtccggggcccagggtcggaaggntacggaaggtntaactacttagttcgtaactcacctagaccacgtagtagaaaatcaacagagaatntcggacggacggaccaggtcngtacccgtcgtaggtcagcccgaagcctcgccccgtcgtacactccgtcgtcccaccgtcctctcctcgtccgtactcgtacgcggcggtacgtaggacgaacgggccgacgtagtacgtcncactnagtncagtcaggccagtacnctgactgacncgtanccgngtaacgntacgngtccacgtacgatcgngtagngtacgtacgtacgtacgtactacgtacgtacgtacgngtccgtacgtacgtacgtagtacg

SEQ ID NO: 70597 - DNA, 467 bp, Homo sapiens
  misc_feature: GYAE6OF02JZPQC.49.26.C04.1.454.CMB.1.raw
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (406)..(406): a, c, t, g, unknown or other
  misc_feature (406)..(406): n is a, c, g, or t
  modified_base (436)..(436): a, c, t, g, unknown or other
  misc_feature (436)..(436): n is a, c, g, or t
  modified_base (441)..(467): a, c, t, g, unknown or other
  misc_feature (441)..(467): n is a, c, g, or t
tcagagtcgagagacacgaccggtgctcgatttagtctagcgactttgggtttggggagatgcattgccaaaaaaatatgcttgttggtaccagaagaagtcaggccaggccccggtgttgcctcatctatgacgacagaaaacgacccctccggggatcccctgagagattcctctggctcccacctccagggacccatcgggccacgttgactactcaggccggggcccagggtcggaggatagaacgggtgaacctcgtaattcgttactcaacccgagccgaccagtagaaatacacaggagaatagtcggnggaggacaagntcgaccgtcacgtcgcgccaaggctccgccccgtcgcacctccttccggtccctaccctcctctacctcgtactccgtntcggacgcggaccgtgacgaacggcacganaggcnnnnnnnnnnnnnnnnnnnnnnnnnnn

SEQ ID NO: 70598 - DNA, 444 bp, Homo sapiens
  misc_feature: GYAE6OF02GOQW5.49.26.C04.1.454.CMB.1.raw
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (236)..(236): a, c, t, g, unknown or other
  misc_feature (236)..(236): n is a, c, g, or t
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (406)..(444): a, c, t, g, unknown or other
  misc_feature (406)..(444): n is a, c, g, or t
tcagagtcgagagacacgaccggtgctcgatttagtctagcgactttgggtttgggggagatgcattgccaaaaaaatatgcttgtggtaccagaagaagtcaggccaggccccggtgttgctcatctatgacgacagaaaacgaccctccggggatccctggagagattcctctggctccaacctcgaagggaccancggccacggttnactatcaggcggggcccaggtggagntgaagtgactactattgtactcaacagacacagtgaaaatcaangagaatatcggacggaggaccaagacgcaccgtctaggtcaacgccaaggctgcccctgacactctcgtcccncctcctctcnctcacncgtnacggcgcngcaagccgactanaggntagcagtnnnnnnnnnnnnnnnnnnnnnnnnnnnnnnnnnnnnnnn

SEQ ID NO: 70599 - DNA, 763 bp, Homo sapiens
  misc_feature: GYAE6OF02GQKBL.49.26.C04.1.454.CMB.1.raw
tcagagtcgagagacacgaccggtgctcgatttagtctagcgactttgggtttgggggaagaggaagactgacggtccccccaggagttcaggtgctgggcacggtgggcatgtgtgagttttgtcacaagatttgggctcaactctcttgtccaccttggtgttgctgagtctgggttttccttgttgtcttattttaaaaggtgtccagtgtgaagtgctagttggtggaatcggtggggagtcgtggtagaggccgtggggggtccctggagactctcctgtgctacgcctctggtaacttcaattcgttagtagtgtattactgacctatcgtacaacgttggacttacccggacgaaaggtccggtaacccggggggtaagggttcgtacggggtaggttcgggtcctttacgtttacttttaagtttaaacgggtttggggtaggtttagggttggttaacgtccctaacgttacttagtcggactaaacggtccttacgtggtaacggtaacgggttccgtaacttaccgaacttacgtacccgtaaccgaggtaacgaaactaacgacgtacgaaactaacccgtccgtagttactcggtagaactaaaggtacgtaaacctagttaccgtaaggtaacgggtaaggtacggtaacccgacccggttcccctaacgtttaccgtaaccttacccgggtttagaaccgtaacgttaaaagttaccggtaaccggttaacctaaccccgttaacccg

SEQ ID NO: 70600 - DNA, 777 bp, Homo sapiens
  misc_feature: GYAE6OF02IHI5M.49.26.C04.1.454.CMB.1.raw
  modified_base (748)..(748): a, c, t, g, unknown or other
  misc_feature (748)..(748): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagcttgggttttccttgttgcttaagttttaaaaggtctccagtgtagaagtgcgtaggttggtaggaattcggtgggggagttcggtaggtaggacgtccggtggggggtccctggacgtacgtctcctgtcgcgaggcctcgtacgtattctattcttgatgtattacgtcgtctagtcgactacggtcgtacttaccggtaacgtaacgggtccgggtaaccgggggttaacgggtcggtagggtacgggttcgttccgtacgttaacgttttaaaggttagggttaacgggttgtacgggttaacgtaccttaccgtaaaccttagtcgtacggacgtaacgtccgtaggtagggttaacgggttacggtacgttccgtaaccttaaccgtacttaccgacgaaaccgaacgtaaaccaacggtaccaaacgtaaccggtaaccttccgttaaacgttctacgtaacgaagtataaccgaaacgttacgtaacgtcgtaaaggtaccgaggacccgtaactccccggttaacttaccgacgttaccgtaggaaaccgttaacgtaacggttaaccgtacggtaacaaccgttaanacccgtttactaccgactaccggtacggg

SEQ ID NO: 70601 - DNA, 828 bp, Homo sapiens
  misc_feature: GYAE6OF02IP9OP.49.26.C04.1.454.CMB.1.raw
  modified_base (251)..(251): a, c, t, g, unknown or other
  misc_feature (251)..(251): n is a, c, g, or t
  modified_base (552)..(552): a, c, t, g, unknown or other
  misc_feature (552)..(552): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgaggcctcctatgagctgacacagccacccgtcggtgtcggtcgtccccgaggacaaacggccaggataacctgctcgtggagtatgactattacgaaaccaaaaaatntagtctttggttacggtaaccagaaggaagtacgacggccgtaaccgggcccccggttgttcggtcctcgtacttcgtacgttaggaaccggaaaccgaaacggaaaaaccccgtacccccggtaccggggtaaccgttaccccggtaggaacggaacgttactttccgttacgttcggcccttacccctaccgtacggaaccgggacctaggtccggtacctaacggttaccgtaacgttacgtaccggtacggaccggggtccccgaggggtcgggaacggtaggttagggtaaacggngttaaccttaacgtttacgttttacgttaacctaccaacccgtaacgaaccgtaacgtaaacggtaaacaaaccgttcgaaacgtaaggtaaacggtaagtttacgggttaccggggacggtaaaccgggaaccgtaacgtacccgtacggtaacccgtaccgttaggtaccgaccggaccccggaagttccccggtacccggtcccccgttaccggtaccttccggttaccgtttcccccgtaaccccgttcccccttacccttccccgttaccg

SEQ ID NO: 70602 - DNA, 696 bp, Homo sapiens
  misc_feature: GYAE6OF02IG04M.49.26.C04.1.454.CMB.1.raw
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
tcagagtcgagagacacgaccggtgctcgatttagtctagcgactttgggtttggggtgggctcaggaggcagagctctgggatctcaccatggcctggaccctctcctgctccccctcctcacttttctgcacagtctctgaggcctcctatgagctgacacaggccaccctcggtgtcggtcgtccccaggacaaacggccaggataacctgctcgtggagagtgactattcgaaccaaaaaaatgtgtacttgttacggtaaccagtaacgaagtcgaggccgagggtccccggtattcggcttcgaattcctatgaccggaaacaacggaaaaccgacccgtaccgggactaccccgtggacgacgtacttccttacgtgtcgtaccctaccgtnacgggcctaacgcggtccctagttacgaccgtagtacgngggaccgggtccgtaggggtacggacggtaagtacggtaacggtcgttaacgtaacttacgttcgttaacgtaccgtacctaccggaacacgtaaacgaggtaaactacgaacgaggaacgtaagttaacgtcgggacgacgggaacagtaccggtagaccgtacgtacggtaccgacggtcccaagggtaccctccggacccgttaccggccgttaccctacggtcccgtacccccggtcctccccgttactcccgg

SEQ ID NO: 70603 - DNA, 765 bp, Homo sapiens
  misc_feature: GYAE6OF02GZ69N.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagttttgtcacaagatttgggctcaactctcttgtccaccttggtgttgctgagctgggttttccttgttgctatttaaaaggtgtccagtgtgaagtgcagttggtggaatcgtgggggagtcggtggtagagccgtggggggtccctggagacctctcctggtcgcacgcctcgtggtacttcacttcttgattagtattatcgaccatcggactacgtcggtactaccgtacgaacggtaccggtaccggggggtaagggtcgttagggggtacggttacgggttccttaccttcgttttaagtttaaggtttaggggtaagtttgggtaggttaacttaccgtaacccgttaacttacgcgtacgtacgtacgttcgtaggtaacggtacggggttactacgtttccacctactccctaccgaagaacgtaaccaaacgacggaacgtaaaccgttaaaaccctccgttactaacgttcgtaacgtaaaccttaaacggtacgtaaacgacggtttacctaacggtaagggttacgggtaccgacgggtaaaccctccccgttaccgtttaacgttaacgttaccggttgtaaaccgtaaagtaaaccggtaaccgttttacgggacccttaaccctaacccg

SEQ ID NO: 70604 - DNA, 781 bp, Homo sapiens
  misc_feature: GYAE6OF02GFMRJ.49.26.C04.1.454.CMB.1.raw
tcagagtcgagagacacgaccggtgctcgatttagtctagcgactttgggtttggggggaagaggaagactgacggtccccccaggagttcaggtgctgggcacggtgggcatgtgtgagtttttgtcacaagatttgggctcaactctcttgtccaccttggtgttgctgagcttgggttttccttgttgcttattttaaaggtgtccagtgtgagtgcagttggtgatcgtggggagtgtggtagagccgtggggggtccctgagacctcctcctgtcgcacgcctgtggtattacattctttgatgtatttatcgccctagtcgacctacgtaggtacgtcccgtacgaacggtccgggtaccgggggtaagggtcgtgggtaggttcgggttccttcttacgtttaatttaaggttgggttacgttgggtaggttacgtacctaacccgtaagtttacgtcgtacgtaacgttaccgtagttcgggttaaggtaaaccggggttacgttaccttaccgacccgtacgtccctaaccgaacggtaacgaaaccgaaacgaccgaaccgtaaaccgttaacccttaccggttaacgttacgttacctacgtaaaccgtaagtaaccgtaacgtaacgttaccgtaacggtaaggtaacgggttcggaaaccggtaacccgtacccggtttacccttaacgtaaccccgtttaaggtaccgtaaccggaaaggttaaaaccggtaccgtttaaccgggtaccgtaaacccgttaacccgg

SEQ ID NO: 70605 - DNA, 737 bp, Homo sapiens
  misc_feature: GYAE6OF02IF9TL.49.26.C04.1.454.CMB.1.raw
  modified_base (298)..(298): a, c, t, g, unknown or other
  misc_feature (298)..(298): n is a, c, g, or t
  modified_base (315)..(315): a, c, t, g, unknown or other
  misc_feature (315)..(315): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtggaatcgtgggggagtcgtggtagagccgtgggggtccctgagactctcctgtgcagcctctggacttcaattctttgatgattatcgccatncacttggactaccgtanaacgtcggtaccggggaaggtcgtggaggttcggtactcgttactttaagtttaaagttcgggagttagggttcggtaactcctaaaccttaacgtagtcgacgtaacgtacctcggttggtacggaaacggggtttcgtaactttccgaacctaacttccgtaccgaaaggacgaaccaaacggacgtaccgaaacgtaaacccttccgtagttactacgtacgaactaaaagtcgaaacctacgttcctaaaggaggttaacgggtagtaaccggaccctaaacccggttcctttaaccttaccggtaactttacggaacgggtaaactaaaaacggttaacggtttacccgaaccggtaacccaacccgggtttaaacccttttaaggttttacccgaaccccgtagtaaccccggggg

SEQ ID NO: 70606 - DNA, 690 bp, Homo sapiens
  misc_feature: GYAE6OF02H9EAM.49.26.C04.1.454.CMB.1.raw
  modified_base (325)..(325): a, c, t, g, unknown or other
  misc_feature (325)..(325): n is a, c, g, or t
tcagagtcgagagacacgaccggtgctcgatttagtctagcgactttggggtttggggtgggctcaggaggcagagctctgggaatctcacatgcctggaccctctcctgctcccctctcacttctgcacagtctctgacggcctctatcgagctgacacacgccctaccgtcggtggtcggtcgtaccccgaggaaccgaacggccgaaggtactaactcgcgtcgtggagatagactatacgaaaactaaaaagttcgtgtcgtttgtacgtacgagaagaacgtacgacgccgacgggtccggtgtcgactctatcgtaganacggtaacaacggaaccggtcccgacggtcctccgaggtactagtactctacgcgtcctacctacgacgacggtactcgcgaccgttacgacgtacgtgtacgacggggccggcgtaggtacggagtacgaggtacgtagtacgtactttcggtattaaccaccgtaacgtaagaacccgaaacgttagtaaacgaacctagaaacgtaggaacgtaacgtacgggtacgaaccgggagaccgaagtccgtaccggtaccgtagttaccgaccggtaacgtcccggacgtacccgtcccgggaccccttaccggtacctccctttccgggacccctttaccccctcggttaccccctgtaacccg

SEQ ID NO: 70607 - DNA, 972 bp, Homo sapiens
  misc_feature: GYAE6OF02G33XW.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatgggagtttgggctgagcgttgggtttttccttgttgcttaagttttaaaaggtgtacctagtgtagaagtgctaggttggtaggtaatcggtgggggagttcggtaggtaggacggtccggtcggggggttccctaggacgtaccttcctaccgtgtgcacgtccttcgtacggtcttcgtattcgtttggaagttagttaatttacgtccgtacccgagttcggtaaccgtcgttaacgggtacctacccggtacgtaaaccgggtcccggggttaaccggggggtaaggttccggtacgggtacggggtttcggttccgtttacgttttaccgtttaaaggtttaagggttacgggttaggttcgggtaacgttaccgtaaccgttacccttaacgttacggttacggaaccgtagttaaccgttcggtagggttacgggtaacgggtttacgtacgtaccccgtaaacccgtttcggtaaccctttacccgggaaacggtaacccgtaaacgaaacccggtaaaccgtacgtaaaaccccgttaaacccggtttacccgttaaaggtttcccgtaaccgttaacgtaaaaccctaaaggtaaacccggaaccgtttaggaacccctttaaggggaacgggttaacggggtaacccgtaacccgggttaaccccgtaaccccgggtttaacctttaccccgtttaagacccgggtttataaaaccgggtaaaccgttaaaccggttaaccgggtttaacccggaacctaaccccgtttaacccgtttaaaccgtttacccggtttaacctaacccgggttggtaacccccgggg

SEQ ID NO: 70608 - DNA, 741 bp, Homo sapiens
  misc_feature: GYAE6OF02JRX6S.49.26.C04.1.454.CMB.1.raw
  modified_base (605)..(605): a, c, t, g, unknown or other
  misc_feature (605)..(605): n is a, c, g, or t
  modified_base (645)..(645): a, c, t, g, unknown or other
  misc_feature (645)..(645): n is a, c, g, or t
  modified_base (673)..(673): a, c, t, g, unknown or other
  misc_feature (673)..(673): n is a, c, g, or t
  modified_base (733)..(733): a, c, t, g, unknown or other
  misc_feature (733)..(733): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggtagtttgggctgagcgttggttttccttgttgcttaattttaaaaggtgttccagttgtagaagtgcgagttggtggtaatcgtggggatcggtggtagagccgtagggggtccctgacgactcctccgtgtacgcgacgtcctcgtggtacttcgtattcgtttagattacgtattacgtacgtccgtagtcgacgtacgttacggtacgtaccggtactaacgggtcccggtaccgggggtaaggtccggttacgggtaggtttcgggttaccttaccgtttacgtttaacggtttacggttagggaccgtttagggtaccgttacgtttaccctaacgttaacgttagtacgtacgtacgtacgtttcgtacggtaagggtacggttcctagtaacctacctagtttacccaacgagtaacgtaaagtaccgaagtacctaacggaaccctttcgaacgtttancctaaggtaacctagtacgtacggtatacggtagtaacgnggttaaccgaggaccctacgtcccttanaccgtacgttggaaccaagtaacgtcgtaacgcctttaacgcttaaccgttgtacccgtnacgtacgg

SEQ ID NO: 70609 - DNA, 616 bp, Homo sapiens
  misc_feature: GYAE6OF02G51RT.49.26.C04.1.454.CMB.1.raw
  modified_base (574)..(574): a, c, t, g, unknown or other
  misc_feature (574)..(574): n is a, c, g, or t
  modified_base (576)..(616): a, c, t, g, unknown or other
  misc_feature (576)..(616): n is a, c, g, or t
tcagagtcgagagacacgaccggtgctcgatttagtctagcgactttggggtttggggagatgcattgccaaaaaaaatatgcttgttggtaccagaagaagtcaggccaggccccggtgttgctcatctatgacgacaagaaaacgccctccgggactccctggagagtatttctcgtggccttcccacctcgacgggaccagtcggcctagttgactatcgacgggccggggcccagggtgggaggtattaggaagggtcgaacttacttatttcgttactccgaacacgtaccaccgagtaagaaaactctaacaaggaacggtaattacggttccggggacgggtaacggggaaccacggaccggttacgtacccggttccggttacgggtccgaacccggacccgacgggtacccgtcccggtaccccccggttcgtcccgttacttaccgttccccgtttcccccgccccgtttcccttcccgtttcctacccgttccgtacccgtttcgtacgggtaccggccgggtcggtacgggaccggaacggaccgttagaaccgtagctacncnnnnnnnnnnnnnnnnnnnnnnnnnnnnnnnnnnnnnnnnn

SEQ ID NO: 70610 - DNA, 704 bp, Homo sapiens
  misc_feature: GYAE6OF02IOKQ5.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctattttaaaaggtgtccagtgtgaagtgcagttggtgaagtcgtgggggagtcgtggtagagccgtgggggtccctgagactctcctgtcgcagcctcgtggattctacttctttgatgtattatcgccatgaccacgttcgggacttccgtacgaacgggtccgggtaccggggggtaacgggtcgtgggtacgggttcgggttccttaccgtttacgttttaagtttaaggttcgggtagttcgggtgtactaccgtaccttacgtagtcgactacgtctcgtggtagtacgggtcgtacttccgacctaactcgtaaccgagacaacaacgtgacaacgtacccttcgtagtctaccgagaataacgttacaacgtctcgtaacggaggtaggtacgtaaccggaccctacccggttactttaccgtaccgttgtacggccgtaaaccggttaaaagttaccggttaccggaaccgaaccccctttaacgttaccgttttaacgtttaccgaaccccggtccgtaaccgggg

SEQ ID NO: 70611 - DNA, 645 bp, Homo sapiens
  misc_feature: GYAE6OF02GD4DP.49.26.C04.1.454.CMB.1.raw
  modified_base (302)..(302): a, c, t, g, unknown or other
  misc_feature (302)..(302): n is a, c, g, or t
  modified_base (607)..(607): a, c, t, g, unknown or other
  misc_feature (607)..(607): n is a, c, g, or t
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagtctggttttccttgttgcttatttaaaaggtgtccagtgtgaagtgcagttggtgaagtcgtggggagtcggtggtagaggccggtggggggtccctgagactctctgtgcacgcctcgtggtatctattcttgatgatttagtcgtcctntcgcacgtggactccgtcgaacgtcggtaccggggaggtcgtgggtcgtcggtcttcgttacttagttagtgggtatggtgtactacgacgtatatcgcgtacgtctcgtgtaggtacggtcgtacttccaccgtctcgtaccgagacgtaaacacgtacgacaaaccgtacttaccgtcgttacgtctaccgagtaaactacgtaacgacgttacgagtaacggagggttacgaacccggtacctacccgttaccttaccgtacctacggtcgtaacggaacctaaacggtacgtggtaacccncgtaaccgttactttggaacctaccgtccggtaaccgg

SEQ ID NO: 70612 - DNA, 701 bp, Homo sapiens
  misc_feature: GYAE6OF02ICDWL.49.26.C04.1.454.CMB.1.raw
  modified_base (135)..(135): a, c, t, g, unknown or other
  misc_feature (135)..(135): n is a, c, g, or t
  modified_base (237)..(237): a, c, t, g, unknown or other
  misc_feature (237)..(237): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (462)..(462): a, c, t, g, unknown or other
  misc_feature (462)..(462): n is a, c, g, or t
  modified_base (480)..(480): a, c, t, g, unknown or other
  misc_feature (480)..(480): n is a, c, g, or t
  modified_base (498)..(498): a, c, t, g, unknown or other
  misc_feature (498)..(498): n is a, c, g, or t
  modified_base (534)..(534): a, c, t, g, unknown or other
  misc_feature (534)..(534): n is a, c, g, or t
  modified_base (560)..(560): a, c, t, g, unknown or other
  misc_feature (560)..(560): n is a, c, g, or t
  modified_base (630)..(630): a, c, t, g, unknown or other
  misc_feature (630)..(630): n is a, c, g, or t
tcagagtcgagagacacgaccggtgctcgatttagtctagcgactttgggtttgggggaagaggaagacgtgacggtccccccaggagttcaggtgctgggcacggtgggcatgtgtgagtttttgtcacaaagntttgggcttcaaactctcttcgtcctacctttgggtgttgcctgagtcttggggttttccttagttgtacttaagttttaaaaggtcgtccagtgtgaagtncgtaggttcgtggaatcggtagggggtactcggttaggtaagcgtccgggttgggggtccctggtaagtcctcctccgttggtcgcacggtcctaggtcgattacngttctttagatgtaattacgnccgtangcacgtgactccgtacgaagtccggtacggggaagtcgtggagtggtctacgttcttaagttaggngtntggtactacgtctaactgtacgnctaacgtctgtagtacgnggtacacgtacacgttanaccgtagaacacgaacctaacgtcgaaaccgttaanaaaccggtccttaagtaactccgtanaaaaccgtaattccggaaacttacgtaccgtaagtacgggacgtacgggtaaacctcccgtaacccgttntaaaccgtttccgtaacgtaaggtaacgaaaaccgtaacggtttaacgcgtttaaacccgccgtttaaacc

SEQ ID NO: 70613 - DNA, 859 bp, Homo sapiens
  misc_feature: GYAE6OF02I58WM.49.26.C04.1.454.CMB.1.raw
tcagagtcgagagacacgaccggtgctcgatttagtctagcgactttgggtttgggggctctgggaaaggagccccagccctgagattcccaggtgtttccattcggtgatcagcactgaacacagaactcaccatggagtttgggctgagctgggttttccttgttgctaattttaaaaggtgtccagtgtgaagtgcagttggtggaatcgtggggagtcgtggtagagccgtggggggtcctgacgacttctccgtgtcgcagtcctcgtggtacttcattcctttagattgtattagtcgaccctatacgactacgttcgggtaacttccccgtacaaacgggtccggttacccgggggggaaggggttccgtacggggtacgggtttacggggttacctttccgttaccgttttaagtttaacggttacgggggtaggtttcgggtttaggttaaccttccgttaaacccttacgttacgtacggaccgtaagttactaccgttagggtaaaccgggttaaggggtttacccgttacgttacccggtaaacctaacgggtttaccccaaccgtaacggttaaacgggaaacccaaaccgtacgggtaaaccctaaaacggggttaaacccccgttttacctaggtttaaacccgtcggtaaactaaaccggtaaaacgtttacgaaaacctttggggtaaccttaacgaacggggtacgggacgaaccggtaccccgtacggttaccctttacgacgttaccggtggtaaacgttaacggtaaaacttacggttaaccgaccgttaactaacccggttactttaacggtttacccgaccgtcggtaacccgggg

SEQ ID NO: 70614 - DNA, 844 bp, Homo sapiens
  misc_feature: GYAE6OF02GO2NV.49.26.C04.1.454.CMB.1.raw
  modified_base (214)..(214): a, c, t, g, unknown or other
  misc_feature (214)..(214): n is a, c, g, or t
  modified_base (250)..(250): a, c, t, g, unknown or other
  misc_feature (250)..(250): n is a, c, g, or t
tcagagtcgagagacacgaccggtgctcgatttagtctagcgactttgggtttggggtgggctcaggaggcagagctctgggaatctcaccatggcctggacccctctcctgctccccctcctcactttctgcacagtctctgacggcctcctatgagctgacacagccaccctcggtgtcggtcgtccccaggacaacggccaggactaaccngctctggagtatgcattacgaaacctaaaaaaattntagctttaggttcggtaacctaggaagaagtacgacggccgtacgggtccccggtgttcgctcactctatcgaacgacgaacgaaaacccgtcccgtaccgggtactcccgtaggaacgagttacgttctccgtcggtccctaccacccgttacggaccgggaccgtacgtaccgggcctaacggttcggaaccttacggtaccggacgggggtacccggggacccggtaagggggtacggggtaacgggaaggttaagggtaaacggggttacggtaaccctttacggttaacgttttccgttaaccttacccgtaacccaccgtaaccgaacccgttaaggtaaacggttaaaactacgaacggtaaaggaacggttaaattaaccgggtaccgggggaacgggtaaccgggtaaccgaaaccgggttcgttacccggtaaccggttacccgttacgggacccgacccgggtaacccgggtaaccggtacccccggttcccggttacccccggtacccggtttaccgttacccgttcccgggtttaacccggtcccccccggtttacccgttccccgttaccctttccccgg

SEQ ID NO: 70615 - DNA, 742 bp, Homo sapiens
  misc_feature: GYAE6OF02H94H1.49.26.C04.1.454.CMB.1.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (579)..(579): a, c, t, g, unknown or other
  misc_feature (579)..(579): n is a, c, g, or t
tcagagtcgagagacacgaccggtgctcgatttagtctagcgactttgggtttgggggtgggctcaggaggcagagctctgggaatctcaccatggcctggacccctctcctgcctccccctcctctactttctgcacagtctctggacggcctcctagtgacgctgacacacgccacccgtcggtgtcggtcgtcccaggacaacggccaggactaccngctcgtggagatcgnattagaaacctaaaaaatgtagtacgtttggttacgtacgaaggaagtaacgtacgacggccgaccgggtcccggttgttcgactcgtattactaagtagaaccgaacaaacggaaaacccgccccgtaccgggtaacttccccgaggaacgtacgttacgttccgttcgtacggtccctaccctaccgttacggaaccggtacctacgtccgggtaacctaacggttacgaacctttacggccgaacggggtcccgggaccggtaggggacgggtaggtaacgagggtaacgtacgttaacgttacgtttagttacgactacaaccctaacggacctaaacgngtaaacgtaaaactccgaaagtaacggtaagttaaccgttacgggtaccgggaaggtacggaacccgtagtccgtcggtaccgtagtacgaccgacgacgagtcccgtcgaccccggttgtacccgttacttccctcccgtttccctacccttcgttcctccg

SEQ ID NO: 70616 - DNA, 720 bp, Homo sapiens
  misc_feature: GYAE6OF02HUP1O.49.26.C04.1.454.CMB.1.raw
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
tcagagtcgagagacacgaccggtgctcgatttagtctagcgactttgggtttggggtgggctcaggaggcagagctctgggaatctcaccatggcctggaccctctcctgctccccctcctcactttctgcacagtctctgacggcctcctagtgagctgacacagccaccctcggtgtcggtcgtccccgaggaccaacggccgaggactaacctgctgtggagntgctatgaacaaaaatntgcgttgtcgtacaagaagagtcgacggccncggtacccgtgtcgcgtacacgtctagtacgacgagtaaccggaaaaccgtcccggtacggacttcccgaggaacgtacgttacttaccgtcgacgtccaccgtaccgtaccggaccggaacctcgtcggaccctagtacgactacgtcgacggcggggccgtaggggacgaggtacgaggtaacgtacgtaacctagttactttacgacctacctaacgactaacgaaccgtaggaaataaccgtactaacgaagtacgggtaactaaggtcgggaaccgggtaaggaccctagggtaccctacgggtaacccgtaccgggtaaccgtacccggtaccggtaccccggtaacggggtaccccttcccgggtacccccggttacgtaccgttaccccttaccggttccccgtacccccgtacgttcccccgtacgtttacccccg

SEQ ID NO: 70617 - DNA, 176 bp, Homo sapiens
  misc_feature: GYAE6OF01CP6T6.14.37.D04.1.454.CMB.1.raw
  modified_base (174)..(176): a, c, t, g, unknown or other
  misc_feature (174)..(176): n is a, c, g, or t
tcagcgtctagtaccacgaccggtgctcgatttagtagcatactgttgggtttgggggaaggaggaagactgacggtcccccaggagttcaggtgctgggcacagcggccctgggctgcctggtcaaggactacttccgtactagacgctgagcgggctggcaaggcgcatagnnn

SEQ ID NO: 70618 - DNA, 215 bp, Homo sapiens
  misc_feature: GYAE6OF01C0NX1.14.37.D04.1.454.CMB.1.raw
  modified_base (215)..(215): a, c, t, g, unknown or other
  misc_feature (215)..(215): n is a, c, g, or t
tcagcgtctagtaccacgaccggtgctcgatttagtagcatactgttgggtttgggaagaggaagactgacggtccccaggagttcaggtgctgggcaccgtgggcatggggaggtgtgtcacaagatttgggctctgggcacagcggccctgggctgcctggtcaaggactacttccgtactagacgctgagcgggctggcaaggcggcatagn

SEQ ID NO: 70619 - DNA, 171 bp, Homo sapiens
  misc_feature: GYAE6OF01BV5ER.14.37.D04.1.454.CMB.1.raw
  modified_base (171)..(171): a, c, t, g, unknown or other
  misc_feature (171)..(171): n is a, c, g, or t
tcagcgtctagtaccacgaccggtgctcgatttagtagcatactgttgggtttggggaagaggaagactgacggtccccaggagttcaggtgctgggcacagcggccctgggctgcctggtcaaggactacttccgtactagacgctgagcgggctggcaaggcgcatagn

SEQ ID NO: 70620 - DNA, 173 bp, Homo sapiens
  misc_feature: GYAE6OF01BDK50.14.37.D04.1.454.CMB.1.raw
  modified_base (172)..(173): a, c, t, g, unknown or other
  misc_feature (172)..(173): n is a, c, g, or t
tcagcgtctagtaccacgaccggtgctcgatttagtagcatactgttgggtttggggaagaggaagactgacggtcccccaggagttcaggtgctgggcacagcggccctgggctgcctggtcaaggactacttccgtactagacgctgagcgggctggcaaggcgcatagnn

SEQ ID NO: 70621 - DNA, 512 bp, Homo sapiens
  misc_feature: GYAE6OF01E6HXI.14.37.D04.1.454.CMB.1.raw
  modified_base (496)..(512): a, c, t, g, unknown or other
  misc_feature (496)..(512): n is a, c, g, or t
tcagcgtctagtaccacgaccggtgctcgatttagtagcatactgttgggtctgggtgcgccagatgcccgggaaaggcctggagtggatgggaaggatcgaccccattgactcttatacgtactacagcccttctttccaaggccacgtcaccatctcaactgacaagtccacaagtactgcctacctgcagtggagcaacctgagggcctcggacaccgccatctattactgtgcgagacgttaattgtagttaatatgaacttgttatttcgagggactggggccagggaacctggtcaccgtctcctcacgcctccaccgaacgggcccagtccggtccttcccccgtggcccacccctcctaccaagcgccgacctcgtcgggggccacgacgccgggcccgtgggcctgcccgttggtaccaacggtaccttaccgttcccgtacgtaggaccgtcgtggaggccgggctgggacgaagggcgcagtagnnnnnnnnnnnnnnnnn

SEQ ID NO: 70622 - DNA, 688 bp, Homo sapiens
  misc_feature: GYAE6OF01EJ1MR.14.37.D04.1.454.CMB.1.raw
tcagcgtctagtaccacgaccggtgctcgatttagtagcatactgttgggtttggggctgccctttggctttggagatggttttctcgatgggggctgggagggctttgttggagaccttgcacttgtactccttgccattcagccagtcctggtgcaggacggtgaggacgctgaccacgacggtacgtgcttgttgtactgcctccgtccgcggtctttgtcttcggctattatgcctaccctccgaccgccgtaccacgtacagttcgacttgacctgaggtcttcgtcgctcctcaccaccagctggactcgtcgacggttcctttccgttttccgtcgttcccttccgtaccgaggtacgttcgggaccctaaccccgcctacgtcccctcctaccccgttcctccgtcgtccttacgtttccaccgtaaggtcgtcgtcggtcggaccggtaggtcgccgtacggtcgtcgggtcgccgtcggtaccgagtacgagtaacggttagaaccgggtacggacccgggtatccgtacgtcggtacggtacttccgtacgtggtacgggtaggttcgttcggtacgtacggtacgtacggttccgttaccggtacgtcggtacggtacgtcgtggtccgggtaggacggccgtacgacggtacggtaccgggaaccgggtaacggg

SEQ ID NO: 70623 - DNA, 174 bp, Homo sapiens
  misc_feature: GYAE6OF02GJ3KW.14.37.D04.1.454.CMB.1.raw
  modified_base (173)..(174): a, c, t, g, unknown or other
  misc_feature (173)..(174): n is a, c, g, or t
tcagcgtctagtaccacgaccggtgctcgatttagtagcatactgttgggtttgggggaagaggaagactgacggtcccccaggagttcaggtgctgggcacagcggccctgggctgcctggtcaaggactacttccgtactagacgctgagcgggctggcaaggcgcatagnn

SEQ ID NO: 70624 - DNA, 176 bp, Homo sapiens
  misc_feature: GYAE6OF02IW16T.14.37.D04.1.454.CMB.1.raw
  modified_base (172)..(176): a, c, t, g, unknown or other
  misc_feature (172)..(176): n is a, c, g, or t
tcagcgtctagtaccacgaccggtgctcgatttagtagcatactgttgggtttggggaagaggaagactgacggtcccccaggagttcaggtgctgggcacagcggccctgggctgcctggtcaaggactacttccgtactagacgctgagcgggctggcaaggcgcatagnnnnn

SEQ ID NO: 70625 - DNA, 175 bp, Homo sapiens
  misc_feature: GYAE6OF02G3OL9.14.37.D04.1.454.CMB.1.raw
  modified_base (173)..(175): a, c, t, g, unknown or other
  misc_feature (173)..(175): n is a, c, g, or t
tcagcgtctagtaccacgaccggtgctcgatttagtagcatactgttgggtttgggggaagaggaagactgacggtcccccaggagttcaggtgctgggcacagcggccctgggctgcctggtcaaggactacttccgtactagacgctgagcgggctggcaaggcgcatagnnn

SEQ ID NO: 70626 - DNA, 633 bp, Homo sapiens
  misc_feature: GYAE6OF02GF99W.14.37.D04.1.454.CMB.1.raw
  modified_base (334)..(334): a, c, t, g, unknown or other
  misc_feature (334)..(334): n is a, c, g, or t
  modified_base (602)..(609): a, c, t, g, unknown or other
  misc_feature (602)..(609): n is a, c, g, or t
  modified_base (611)..(613): a, c, t, g, unknown or other
  misc_feature (611)..(613): n is a, c, g, or t
  modified_base (615)..(633): a, c, t, g, unknown or other
  misc_feature (615)..(633): n is a, c, g, or t
tcagcgtctagtaccacgaccggtgctcgatttagtagcatactgttgggtctgggtgcgccagatgcccgggaaaggcctggagtggatgggaaggatcgaccccattgactcttatacgtactacagcccttctttcaaggccacgtcaccatctcaactgacaagtccacaagtactgcctacctgcagtgagcaaccgtgagggcctcggacaccgccatctattactgtgcgagacgtaattgtagttaatatgtaactagtttatttacgagggtacgtcggggaccgtaacgggaaccccgtggtccgtaccgtaccgttccctacncggccctaccccgaaccgaaccgggaccctacgttccggttccccttcccccggttccggaccctaccccgttccctaccgtaacgaccgtaccctacccggtcgggtaccgggggaccaccggacggccccgggtcccggtaggggtcccgtcggtcccgtacgggttaccgaaccggtaacccgtttaccgtttacccgtaacgtaaccggccgtaccgtggacgggccgggtacggcgaccggaaggccgacgaatcggatcgannnnnnnngnnncnnnnnnnnnnnnnnnnnnn

SEQ ID NO: 70627 - DNA, 177 bp, Homo sapiens
  misc_feature: GYAE6OF01CXVHS.39.34.D01.1.454.CMB.1.raw
  modified_base (173)..(177): a, c, t, g, unknown or other
  misc_feature (173)..(177): n is a, c, g, or t
tcagtcgcactagtcacgaccggtgctcgatttagatcgtctgtgttgggtttgggggaagaggaagactgacggtcccccaggagttcaggtgctgggcacagcggccctgggctgcctggtcaaggactacttccactagtgcgactgagcgggctggcaaggcgcatagnnnnn

SEQ ID NO: 70628 - DNA, 179 bp, Homo sapiens
  misc_feature: GYAE6OF01C8K6W.39.34.D01.1.454.CMB.1.raw
  modified_base (172)..(179): a, c, t, g, unknown or other
  misc_feature (172)..(179): n is a, c, g, or t
tcagtcgcactagtcacgaccggtgctcgatttagatcgtctgtgttgggtttgggggaagaggaagactgacggtcccccaggagttcaggtgctgggcacagcggccctgggctgcctggtcaagactacttccactagtgcgactgagcgggctggcaaggcgcatagnnnnnnnn

SEQ ID NO: 70629 - DNA, 549 bp, Homo sapiens
  misc_feature: GYAE6OF01A1GTT.39.34.D01.1.454.CMB.1.raw
  modified_base (540)..(540): a, c, t, g, unknown or other
  misc_feature (540)..(540): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaacgacacggccgtgtacttctgtgcgagaggcagagttccactgggataagtgcgaattcgatggttttgatgtctgggcaagggacaagtggtcaccgtctctcagcctccaccaaggcccatcggtccttccccgtgccaccctcctcccaagcgcaccctcgtcggggccacgacgccggcccgtgggcctcggcccgtcgggtccgaaggaccttaccgttcccgacttacgtcgacgacgtcgnggcgggtcg

SEQ ID NO: 70630 - DNA, 558 bp, Homo sapiens
  misc_feature: GYAE6OF01B0J1C.39.34.D01.1.454.CMB.1.raw
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaaatatgcacagagatttcagggcagggtcaccatgactcgggacacgtccatcaaaacagcctacatggaattcagtagactgaagtccaacgacacggccgtgtacttctgtgcgagaggcagagttccactgggataagtgcgaatttcgatggtttgatgtcgtggggccaagggacaagtggtcaccgtctcttcagcctccaccaacggcccatcgtctcccctgccaccctcctccaacgacgccacccgtcgtcggggcacgacgccggcccgtcgggccgtcgcccgtcggtccgaagggaccttaccttccgaaccgttacggtcgacggactggacggcgggtccg

SEQ ID NO: 70631 - DNA, 528 bp, Homo sapiens
  misc_feature: GYAE6OF01DMK1Z.39.34.D01.1.454.CMB.1.raw
  modified_base (226)..(226): a, c, t, g, unknown or other
  misc_feature (226)..(226): n is a, c, g, or t
  modified_base (356)..(356): a, c, t, g, unknown or other
  misc_feature (356)..(356): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (484)..(484): a, c, t, g, unknown or other
  misc_feature (484)..(484): n is a, c, g, or t
tcagtcgcactagtcacgaccggtgctcgatttagatcgtctgtgttgggtttggggagagcatcgcccagcaaccacatctgtcctctagagaatcccctgagagctccgttcctcaccatggactggacctggaggatcgtcttcttggtggcagcagtcacaggagcccagtcccaggtgaacttggtgcagtctgggtttgaggtgagaagcctggggcctnagtgaaggtcccctgccaggcttctggatacatcttcagcgcctattatatacactgggtgcgccaggcccctggacaagggcctgagtggatgggatgtatcgaaccccgagagtggcgacacaaaatntagacacagagatttcgagggcaggtcacatgactcgggacacgtcatacaaacngacctanatgaattcgagtagactgaacgtaccaacgacacggaccgtgtacttcgtcgtgacgaggaggacnggacgttccacggttggggaataaggtgtacgtaagtttacggg

SEQ ID NO: 70632 - DNA, 683 bp, Homo sapiens
  misc_feature: GYAE6OF01EDF8U.39.34.D01.1.454.CMB.1.raw
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggagtgggatgtatcaaccccgagagtggcgacacaaaatatgcacagagatttcagggcagggtcaccatgactcgggacacgtccatacaaaacagcctacatggaattcagtagactagaagtaccaacgacacggccgtgtaccttctgtgcgagagcgagtacgtccacgtgggataaggtgacgtaatttcgtagttggttttagagttgttcgtggggaccgtaaagggactaagttcggtacctaccgttcgtaccttcgacgtcccctacccgaacccgaacgggtcccccacgttcccggttcccctttcccccccgtcgggtcccctacccccttcccgtaccccaacggaccgcccgtaaccccgtccggttaccggggggacctaccgacgggtcccggtccccgttggggcccgtcggtcccgttacggttaccgaacgggtacccttacccgttaccgtaaccgttacgggttcggaccggtaccgttggcggcgggtaccgg

SEQ ID NO: 70633 - DNA, 640 bp, Homo sapiens
  misc_feature: GYAE6OF01D827S.39.34.D01.1.454.CMB.1.raw
  modified_base (260)..(260): a, c, t, g, unknown or other
  misc_feature (260)..(260): n is a, c, g, or t
  modified_base (477)..(477): a, c, t, g, unknown or other
  misc_feature (477)..(477): n is a, c, g, or t
tcagtcgcactagtcacgaccggtgctcgatttagatcgtctgtgttgggtttggggagagcgatcgcccagcaaccacatctgtcctctagagaatcccctgagagctccgttcctcaccatggactggacctggaggatcgtcttcttggtggcagcagtcacaggacgcccagtcccaggtgaacttggtgcagtctgggttgaggtgaagaagccgtggggcctcgagtcgacggtcccctgcccgaggtcttcgnggatacgatcgttcagtcgtacctattatatacacgtgggtacgccgtccgacggccccgtaggaccgaacgggccgtggaacggtggtagtggggatgtactaccgtaaccccggagtacggtggaccgaacaactaaaatacgtgacacgaagagtattcgaagggcgtaggtccaacgagtcggtaccgtcgacgtacgaccactaacgaaacncgaccctaagagtacgtactacgaagtacgactacgaacgtaccgaacgaccgacggtccgtacgtaccgtcgtacggtcgtaccggtacggacggtagtaccgtaccggtaccgtaacgggtacggtaacgttaggtacggttaacgttacggtttaacggg

SEQ ID NO: 70634 - DNA, 587 bp, Homo sapiens
  misc_feature: GYAE6OF01EUMAQ.39.34.D01.1.454.CMB.1.raw
  modified_base (579)..(579): a, c, t, g, unknown or other
  misc_feature (579)..(579): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacaacaaaatatgcacagagatttcagggcagggtcaaccatgactcgggacacgtccaatacaaaacacgcctacataggaattcaagtagactgaacgtaccgaacgacacgggccgttagtaccttcgtggtgcggagagcagtacgttccacgtgggaattaagtgacgtaagtttcgagtttggttttagagttggtacgtcggggacgaacgggactaagttcggtcgtaccggttctcttacacgtccctaccacgacggcccctagtccggtcctccccgtgcctaccctcctcaacgcgcaccgtcggcgggcacgcgcccgccgtggctcgcgtcggtacaaggccttaccgtacctactacgtcgacatcggngcgggtcg

SEQ ID NO: 70635 - DNA, 673 bp, Homo sapiens
  misc_feature: GYAE6OF01CMLYY.39.34.D01.1.454.CMB.1.raw
  modified_base (250)..(250): a, c, t, g, unknown or other
  misc_feature (250)..(250): n is a, c, g, or t
  modified_base (285)..(285): a, c, t, g, unknown or other
  misc_feature (285)..(285): n is a, c, g, or t
tcagtcgcactagtcacgaccggtgctcgatttagatcgtctgtgttgggtttggggagagcatcgcccagcaaccacatctgtcctctagagaatcccctgagagctccgttcctcaccatggactggacctggaggatcgtcttcttggtggcagcagtcacgaggagcccagtcccaggtgaacgttggtgcagtcgtgggttgaggtgaagagcgtgggcctcagtgacgtccctgccaggctcgngatacgatctcagcgcctattatatacacgtgggngcgccgacggccccgtggacgaagggcctggacgtggagtgggatgtactacgaaccgagagtcggacgaacaacaaaatagtgacacgaagagtacgtttacgagggtcgacgggtaccgaccgtacgtacggaccggtacgggaaccgaaccggttaaccaacgtaacccaaaaaccgtaccggtaaccctaaccgaacgttaacgggtaacgttaacgaacggttaacgtaaccgtaggtaaaccgtaccgaaaccggtaaccgtaccgggtacccgttacggttaaccgttacggtcgtcgggacggtaacgggacggacgtacggtacggttaccggtacggtacggggaaacttaaggtacggtaacggttagtttaacggg

SEQ ID NO: 70636 - DNA, 795 bp, Homo sapiens
  misc_feature: GYAE6OF01CQR3L.39.34.D01.1.454.CMB.1.raw
tcagtcgcactagtcacgaccggtgctcgatttagatcgtctgtgttgggtttggggagagcatcgcccagcaaccacatctgtcctctagagaactcccctgagagctccgttcctcaccatggactggaccgtggaggatcgtcttcgttggtggcagcgagtcacgaggacgcccacgtcccgaggtagaacgttggtgacgagttcgttgggtttaggaaggtagaagaacggccggtcggggcctacgaggtacggtaaccggtccccgtggccgtaggttccgttacgtaggtactacgtacttccgttaccgaagtccgttaaccttatttaacttaacgtaccgtacggtggggtaccgccgaccggaccggtaccccgtaggaaccggacgggtcgtagggaggtaggtaggtgggtacgttagtaaccacccggaacccggtaggtacggtaacgggaccaaaacgtaaaaacgtaaactacgtacggaacctaaagaaggtaagttacgttacggaagggccgtaaacgggtctaaccgtagtaaccggaccggttaccggaacaaccggtaacaacgtaaacgaaaccgtacgtaacccgtaagtaaccgttaaggtaacttacggtaaacggtaacgtaacgtaaccggtaaaacccgtacccggaaaacggtcccggaaccggtttaaccggtacgtttaaccgttcggacgtagggacgtaaggactacggtacggtaccgtacggaggtaaggtactaaggtcgtagttaaggttacgg

SEQ ID NO: 70637 - DNA, 803 bp, Homo sapiens
  misc_feature: GYAE6OF01C1C0H.39.34.D01.1.454.CMB.1.raw
  modified_base (62)..(62): a, c, t, g, unknown or other
  misc_feature (62)..(62): n is a, c, g, or t
  modified_base (731)..(731): a, c, t, g, unknown or other
  misc_feature (731)..(731): n is a, c, g, or t
  modified_base (737)..(737): a, c, t, g, unknown or other
  misc_feature (737)..(737): n is a, c, g, or t
  modified_base (762)..(762): a, c, t, g, unknown or other
  misc_feature (762)..(762): n is a, c, g, or t
  modified_base (782)..(782): a, c, t, g, unknown or other
  misc_feature (782)..(782): n is a, c, g, or t
tcagtcgcactagtcacgaccggtgctcgatttagatcgtctgtggttgggtttggggggancatcgcccagcaaccacatctgtcctcgtagagaactcccctgagagctccgttcctcaccatggactggacctggaggatcgtcttcgttggtcggacagcagtcaacgaggacgcccaggtcccaaggtcgtaacgttggtgcgtagttcgttagggtttaggaggtagaacggaacggcgtcggggtacctacgtagtacgtaacggtccctggaccgtaggtcttcgtacggataactcgttcgttccgagtccgtactttaacttaacttaacgtaccgtaacggttcgggtacggaccgcccggaaccggtccccggtacgggaacggtaacgggaccgtttggagggttacgggaagttgggtaagttcggtaaccgtaacccggaaccccggtaaggacggttcggaaaccgtaaacggtaactaaaagtacgtacggtaaaccgagaagttacgttaacggttaacggagggacggtacgggaacctaacgtacgggtacgtaccggtaaccggggtaacctacggtacctaaacgtaacccgaaacgttaccggaacctaaaccggagttaaccgggttaaactccgtaaagggtaacgttacgaacggtaaaccgtacctaaggggacctacgggtaccttacgttacttaggtcggnaacggnggtacgactaggtaccttaaccggnggtaaaggtcgtaaacggtntaaacggttgttgttaacggg

SEQ ID NO: 70638 - DNA, 186 bp, Homo sapiens
  misc_feature: GYAE6OF02HE25H.39.34.D01.1.454.CMB.1.raw
  modified_base (172)..(186): a, c, t, g, unknown or other
  misc_feature (172)..(186): n is a, c, g, or t
tcagtcgcactagtcacgaccggtgctcgatttagatcgtctgtgttgggtttgggggaagaggaagactgacggtcccccaggagttcaggtgctgggcacagcggccctggctgcctggtcaaggctacttccactagtgcgactgagcgggctaggcaaggcgcatagnnnnnnnnnnnnnnn

SEQ ID NO: 70639 - DNA, 262 bp, Homo sapiens
  misc_feature: GYAE6OF02F9GHR.39.34.D01.1.454.CMB.1.raw
  modified_base (248)..(262): a, c, t, g, unknown or other
  misc_feature (248)..(262): n is a, c, g, or t
tcagtcgcactagtcacgaccggtgctcgatttagatcgtctgtgttgggtttgggagaggcgggtggcattttgactactggggccagggaaccctggtcaccgtctcctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnnnnnnnnnnnn

SEQ ID NO: 70640 - DNA, 596 bp, Homo sapiens
  misc_feature: GYAE6OF02HHP1V.39.34.D01.1.454.CMB.1.raw
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatcgcacagagatttcagggcagggtcaccatgactcgggacacgtccatcaaaacagcctacatggaattcagtagactgaagtccaacgacacggccgtgtacttctgtgcgagaggcagagttccacgtgggataagtgcgtaatttcgattggttttgattgtcgtggggccaagggacaagtggtcaccgtctcttcacgtccctccaaccgaacgggcccaagtccggttcctttccccccgtggccctaccctccctccaacgaccgccacccgtcgtcgggggccacgacggccggcccgtgggcctcggcccgtcgggtaccgaacggtaccttaaccgttcccaacgttacggtcggaccgtaccgtcggacggccgggtcg

SEQ ID NO: 70641 - DNA, 520 bp, Homo sapiens
  misc_feature: GYAE6OF02HBKQ9.39.34.D01.1.454.CMB.1.raw
  modified_base (227)..(227): a, c, t, g, unknown or other
  misc_feature (227)..(227): n is a, c, g, or t
  modified_base (462)..(462): a, c, t, g, unknown or other
  misc_feature (462)..(462): n is a, c, g, or t
tcagtcgcactagtcacgaccggtgctcgatttagatcgtctgtgttgggtttggggagagcatcgcccagcaaccacatctgtcctctagagaatcccctgagagctccgttcctcaccatggactggacctggaggatcgtcttcttggtggcagcagtcacaggagcccagtcccaggtgaacttggtgcagtctgggtttgaggtgaagaagcctggggcctnagtgaaggtcccctgccaggcttctggatacatcttcagcgcctattatatacactgggtgcgccaggcccctggaccaagggcctgagtggatgggatgtatcaacccgagagtggcgacacaaaatatgcacagagatttcagggcagggtcaccatgactcgggacacgtccatacaaacagacctacatggaattcagtagactgaagtccaacgacacggctgtaccttntgtgcggagtaggcgaagacgttaccacgtggggaattaaggtagacgtaatttacgg

SEQ ID NO: 70642 - DNA, 521 bp, Homo sapiens
  misc_feature: GYAE6OF02G6B0K.39.34.D01.1.454.CMB.1.raw
tcagtcgcactagtcacgaccggtgctcgatttagatcgtctgtgttgggtttggggagagcatcgcccagcaaccacatctgtcctctagagaatcccctgagagctccgttcctcaccatggactggacctggaggatcgtcttcttggtggcagcagtcacaggagcccagtcccaggtgaacttggtgcagtctgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatagcacagagatttcgagggcagggtcacgatgacgtcgggacacgtccatacaaacacgacctacatggaattcgagtagactgaacgtaccaacgacacggcctgtacttctgtgacgagaggctagacgttccgacgttgggataaggtgacgtagttacgg

SEQ ID NO: 70643 - DNA, 253 bp, Homo sapiens
  misc_feature: GYAE6OF02HGGMU.39.34.D01.1.454.CMB.1.raw
  modified_base (247)..(253): a, c, t, g, unknown or other
  misc_feature (247)..(253): n is a, c, g, or t
tcagtcgcactagtcacgaccggtgctcgatttagatcgtctgtgttgggtttgggtgccgaagttgctggaggtcacggtcaccacgctgctgagggagtagagtcctgaggactgtaggacagcccatcggtcttccccctggcgccctgctccaggagcacctccgagagcacagcggccctgggctgcctggtcaaggactacttccactagtgcgactgagcgggctggcaaggcgcatagnnnnnnn

SEQ ID NO: 70644 - DNA, 582 bp, Homo sapiens
  misc_feature: GYAE6OF02GQB8J.39.34.D01.1.454.CMB.1.raw
  modified_base (388)..(388): a, c, t, g, unknown or other
  misc_feature (388)..(388): n is a, c, g, or t
tcagtcgcactagtcacgaccggtgctcgattagatcgtctgtgttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttancgttacttatgtcagcattcgcacttctgatacctccagcatgcctcacagcactaccttcacagcttacagtaacgcctacccctacccaactaaccgcactaagccttacggcttcgccgtcagtccttcggtcgctagtcggtttacgccccgtttcacgttccttcccgcctactctacgaacttagtcg

SEQ ID NO: 70645 - DNA, 785 bp, Homo sapiens
  misc_feature: GYAE6OF02JY4KH.39.34.D01.1.454.CMB.1.raw
  modified_base (293)..(293): a, c, t, g, unknown or other
  misc_feature (293)..(293): n is a, c, g, or t
tcagtcgcactagtcacgaccggtgctcgatttagatcgtctgtgttgggtttggggtagagcatcgcccagcaaccacatctgtcctctagagaatccctcgagagctccgttcctccaccactggactggacctggaggatcgtcttcttggtggcagcagtcacaggagcccagtcccaggtgaacttggtgcagtcgtggttgaggtgaagaagcctggggcctcagtgaacggtcccctgccgaggcttctggatacatcttcagcgcctattatatacacgtgggtnccgccacggcccctaggacaagggcctggaagtcgggatggggattacggtagtacccggaaaccccgtagggaagttcggggaccggtaaccaaaacggtaaaaactacgtagaccaccgaaagtaggtacgtttaaccgaacgggggtcggaacggggtaccaaccggtaagtaccgggtaacggttaccggggtaaccggaacccgtttacccgaaaccgtaaaaccgaaaaccgaacggttaccccgtaaacgttaacggttacggggtaaaactttccgtaaaacgggtttaacgggaaaccgtttagggaaaaccgtaaccccgttaaaacgggaacccgtaacccgggtacggttaccgttaacccgttttcggacggtttcgggaaccgggaacgggaacgtacggtaaccggttaacggtttccccgaacgggttagggggtaaacttaccggggtaaggtacccggttaaaagttttccggg

SEQ ID NO: 70646 - DNA, 646 bp, Homo sapiens
  misc_feature: GYAE6OF02JTUIA.39.34.D01.1.454.CMB.1.raw
  modified_base (278)..(278): a, c, t, g, unknown or other
  misc_feature (278)..(278): n is a, c, g, or t
tcagtcgcactagtcacgaccggtgctcgatttagatcgtctgtgttgggtttggggagagcatcgcccagcaaccacatctgtcctctagagaatccctgagagctccgttcctcaccatggactggacctggaggatcgtcttcttggtggcagcagtcacaggagcccagtcccaggtgaacttggtgcagtctgggttttgaggtgaagaagcctggggcctcaggtgaaggtcccctgccgaggcttcgtggatacgatcttcagcgcctatntatacactggtgacgccaggcccctggacaacgggcctggagtggagtgggaatgtatcctaacccggagacggttggaccgacgaaccaaaatacgtagtacacgaaggacgtacttttacgaagggcgaagggttccgaacctacgtagaaccgtaccggggaacaaccggtacctaactacgtaaaaccgacgtaccctaacgtatacggtaaattcctaaaggttaacggacctaggtaaacgttaccgaaaccgaccgaaccggtccggtacgttaccgttactcgtaggcgaacggtacggacgaaggtcgttaacccgacggttacggggaacgttacggtacggtactaggtttaaccgg

SEQ ID NO: 70647 - DNA, 574 bp, Homo sapiens
  misc_feature: GYAE6OF02H7MTI.39.34.D01.1.454.CMB.1.raw
tcagtcgcactagtcacgaccggtgctcgatttagatcgtctgtgttgggtttggggtgaagaagcctggggcctcagtgaaggtccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatacaaaacagcctacatggaattcagtagactgaagtccaacgacacggccgtgtacttctgtgcgagaggcagacgttccacgtggggataagtgtacgtaatttcgattggttttgagttgtctggggccaagggactaagtggtcacgtctcttcacgcctcaccgacggcctagtccggttccttccccgtcggccctaccctcctacccgaacgacgcctacctcgtcggggccacgcggcggcccgtcgggcgtcgccgtcggtctaacggtacctaccgttccacgtacgtcgccgtacgtcggacggcggtacgg

SEQ ID NO: 70648 - DNA, 259 bp, Homo sapiens
  misc_feature: GYAE6OF02FG1RD.39.34.D01.1.454.CMB.1.raw
  modified_base (250)..(259): a, c, t, g, unknown or other
  misc_feature (250)..(259): n is a, c, g, or t
tcagtcgcactagtcacgaccggtgctcgatttagatcgtctgtgttgggtttgggtgccgaagttgctggaggtcacggtcaccacgctgctgagggagtagagtcctgaggactgtaggacagcccatcggtccttccccctggcgccctgctccaggagcacctccgagagcacagccggccctgggctgcctggtcaaggactacttccactagtgcgactgagcgggctggcaaggcgcagtagnnnnnnnnnn

SEQ ID NO: 70649 - DNA, 555 bp, Homo sapiens
  misc_feature: GYAE6OF02H49FY.39.34.D01.1.454.CMB.1.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (317)..(317): a, c, t, g, unknown or other
  misc_feature (317)..(317): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
  modified_base (500)..(500): a, c, t, g, unknown or other
  misc_feature (500)..(500): n is a, c, g, or t
tcagtcgcactagtcacgaccggtgctcgatttagatcgtctgtgttgggtttgaggtgaagaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatcgaccacagacacatccacgagcacggcctacatggacctgaggancctgagntctgaccgacacggcctgtattactgtgngagagagtacggggaaatattttgacgtcggtaccttctttgacttacggtcgggcctaacgggaccctggtcgtacccgtctcctacncgtccccnccaacccgaggccctagtcccggtccttcccctcggcctacccctcnccaagcaccncctcggngggccagacgccgtccgcggcncgccgtgcgaacgcctactccactcgtcgaccgtctggcgcgggctcggcaacgg

SEQ ID NO: 70650 - DNA, 203 bp, Homo sapiens
  misc_feature: GYAE6OF02I9MR3.39.34.D01.1.454.CMB.1.raw
  modified_base (170)..(170): a, c, t, g, unknown or other
  misc_feature (170)..(170): n is a, c, g, or t
  modified_base (176)..(203): a, c, t, g, unknown or other
  misc_feature (176)..(203): n is a, c, g, or t
tcagtcgcactagtcacgaccggtgctcgatttagatcgtctgtgttggggtttggggggaagaggaagactgacggtccccccaggagttcaggtgctgggcacagcggccctgggctgcctggtcaaggactacttccactagtgcgactgagcgggctggcaaggcncatagnnnnnnnnnnnnnnnnnnnnnnnnnnnn

SEQ ID NO: 70651 - DNA, 586 bp, Homo sapiens
  misc_feature: GYAE6OF02IUHOK.39.34.D01.1.454.CMB.1.raw
tcagtcgcactagtcacgaccggtgctcgatttagatcgtctgtgttgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaaattcagtagactgagtaccaacgacacggccgtgtacttctgtgcgagaggcagagttccaacgtgggggataaaggtgacgaagttttcgagtggtttttgacgttgtcgtggggacccaaggggaactaagtgggtcctaccgtcctcgttcacgcctccgacccaacgggacccagttccggtaccttcccccgtggccacccctccctaccaacgacgccacccgtcgtggggccaacgcgccggccctagggcctcggccgtggtccaaggtaccgtaccttccacgtaggtcacggactggagtcggg

SEQ ID NO: 70652 - DNA, 794 bp, Homo sapiens
  misc_feature: GYAE6OF02JN32T.39.34.D01.1.454.CMB.1.raw
tcagtcgcactagtcacgaccggtgctcgatttagatcgtctgtgttgggtttggggagagcatcgcccagcaaccacatctgtcctctagagaatcccctgagagctccgttcctcaccatggactggacctggaggatcgtcttcttggtggcagcagtcagaggagcccagtcccaggtgaacttggtgcgagtcgtgggtttgaggtgaagagccgtgggacctcgagtcggaacgtccctcgccgaggtccttcgtaggtatactagtcctttacgacgtccgtaccttattagtacttaacctcggtacggtcgtacccggaccgtaaccgggcccccggttacgggaaccggtaaccgggtccccgtagggtaaccgggtagggtaaggttcggggtaacgtttaggaaccgttacccgggtaaacccccgtagggtaaccggttcggggaaacctaaccggaaaagtaaaaaccgtagtaccgaaacgtaacgtaacggtaacgttacgtttaacgggaagggtacggacgggttacaaagtcgtacggaccggtaggtaccgaccgtactaactaacgaacgactaaccgtacgaaagttaccgactaaccgtagtaccgtacgtaacgtaaccgtacccggtaacacggacccgtacggtttaaacccgttttaaccggtcgaaccggttacggtaaggtaccggtaaccgaccggttaaccggttaacggacgggttaacggggtaacctaagggtacccggttaacgtaggttttaaccggg

SEQ ID NO: 70653 - DNA, 599 bp, Homo sapiens
  misc_feature: GYAE6OF02G090A.39.34.D01.1.454.CMB.1.raw
  modified_base (352)..(352): a, c, t, g, unknown or other
  misc_feature (352)..(352): n is a, c, g, or t
tcagtcgcactagtcacgaccggtgctcgatttagatcgtctgtgttgggtttggggtgaagaagcctgggcctcagtgaaggtcccctgcaaggcttctggttacccattcaccacctttgctctcagctgggtgcgacaggcccctggacaagggcttgagtggatgggttccgtctacaacacaaaccatgcccagaagttccagggcagagtcaccatgaccacagacacatccacggacacagcctacatggaactgagcagcctagagtatttgacgacacggccatgtattactgtgcgaggtctcttccgacctaaactgagtggtagaacgtaaaaggggttntacgttcgtacgggcgacgggtacccgtggtccaccgtctcctcacgcctaccgaccgacggcccacgtccgtccttccccgtggcccgtccgtcgcctccgaggcgaccacccgtccgacgtacgaccacgacggcccggtccgtggcctcgtccgtggtaccgaacgtacctaccgttaccgacgttacgtcgcgtacgtcggacggtccggcgtacgggaccgtacggtccgacgtacgtagcg

SEQ ID NO: 70654 - DNA, 672 bp, Homo sapiens
  misc_feature: GYAE6OF02G0KNV.39.34.D01.1.454.CMB.1.raw
  modified_base (265)..(265): a, c, t, g, unknown or other
  misc_feature (265)..(265): n is a, c, g, or t
tcagtcgcactagtcacgaccggtgctcgatttagatcgtctgtgttgggtttgggggtgaagaagcctggggcctcagtgaaggtcccctgccaggcttctggatacatcttcagcgcctattatatacactgggtgcgccacggcccctggacaagggcctgagtggatgggatgtatcaaccccgagagtggcgacacaaaatatgcacagagtatttcgagggcagggtcaccatgacgttggacacgtccatacaaaacncgactacatcggaattcgagtagactgaacgtaccaaacgacgacggccgtggttacttctgtcgcggagaggcgagtacgtaccgagtagggataagtgacgttaactttcgagtttggttttgatgttcggtcggggaaccgaacggggtactaagttcggtaccgtacgttcttacgttcgtaccgtccgtacccgaccgaaccggaccctacgttccggttccccgttccccgtcggtcccctaccctcccgtacccgaacgccgacccgtaccgtcggtccgggacgaccgacggtcccggaccgtcgggtccgtccgggtctacgggtaacgaacggttaccgttaaccgttccgtaaccgttcggtacggtacgtaccggttacgggcggtaccggtcgg

SEQ ID NO: 70655 - DNA, 734 bp, Homo sapiens
  misc_feature: GYAE6OF02IMHHM.39.34.D01.1.454.CMB.1.raw
  modified_base (413)..(413): a, c, t, g, unknown or other
  misc_feature (413)..(413): n is a, c, g, or t
tcagtcgcactagtcacgaccggtgctcgatttagatcgtctgtgttgggtttggggagagcatcgcccagcaaccacatctgtcctctagagaatcccctgagagctccgttcctcaccatggactggacctggaggatcgtcttcttggtggcagcagtcacaggacgcccagtcccaggtgtaacttggtgcagtcgtgggtttgaggtagaagaagtccgtggggcctcgagtggaacggtcccctgccgtaggtcttcgtggactacagttcttcgacgccgaccttaattataactacgtacgtgggtcgccgaccgaccgggcccctaggacgaacgggtcctggaggtggagtgggatagtactaccgaaccgagtacgcggacgacaaactaaatctagacaanagtaagtacgttacggacggacgtacgggtacaaccgtagtacggaacgtacgggtaaccgtacgtacccgtaaacgtaacctaaaaaccgaccgttaacccgtaaacgtaaacgttacgtaaacttaccgaaacggttaacgtaacgttaacgaaacggaacccgaaaccggtaaccgtaaccgggttaccggttaaacgtttaccgttacgttacggttaacgggacggaacggtaacgggacgtacggtaaccgtttaacccgggacggtttaacggggtaaagttacggttaacggtacggttaacggtttaaccgg

SEQ ID NO: 70656 - DNA, 694 bp, Homo sapiens
  misc_feature: GYAE6OF02FVLCK.39.34.D01.1.454.CMB.1.raw
  modified_base (314)..(314): a, c, t, g, unknown or other
  misc_feature (314)..(314): n is a, c, g, or t
  modified_base (330)..(330): a, c, t, g, unknown or other
  misc_feature (330)..(330): n is a, c, g, or t
  modified_base (384)..(384): a, c, t, g, unknown or other
  misc_feature (384)..(384): n is a, c, g, or t
tcagtcgcactagtcacgaccggtgctcgatttagatcgtctgtggttggggtttggggagagcatcgcccagcaaccacatctgtccttctagagaatcccctgagagctccgttcctcaccatgactggacctggaggatcgtcttcttggtggctagcagtcacaggagcccagtcccaggttcagtctggtacagtcgtggagctgagatggacggaacgccgtgggcctcgagtcggaacggtcccctgcccaggtccttcgtggattacatcttcagcgtcttagttactactacgacgtcgggtacnccgccgacggtcccgngtaaccggacgggtctggaaggtcggtagtcgggatgtactaccgaaccggagnggtaggaccgaactaaacgtaaaactcgtacgacgacgaagtacgtactttcggacgggacacgggtaccgtaactacgtacgtaaccggtaccggggaacctaccgttcctaagtaaaccctaaaccgacgtacctaaacgtaccgtacggttaaagttaccgaggtaacgtacgttacggtaaacgttaccccaaggtaaccgaaccgggtccgttacgtacgttaccgttggtacggtaacgaaccggttaaggccggtaacggtaccggtttaccaacgggtttacgggacgttaggtaacccggg

SEQ ID NO: 70657 - DNA, 740 bp, Homo sapiens
  misc_feature: GYAE6OF02GSIIM.39.34.D01.1.454.CMB.1.raw
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
tcagtcgcactagtcacgaccggtgctcgatttagatcgtctgtgttggggtttggggtgaagagcctgggcctcagtgaaggtcccctgccaggcttctggatacatcttcagcgcctattatatacactgggtgcgccacggcccctggacaagggcctggagtggatggggatgtataccgaaccccgaggaggtgggccaacaacgtaaaaatgtggacaacgaggtaacgtactttacgaggggactaaggggtccaccgtataggacgtaccggggacctacggtacatacaaaaacngaccctanagtacggtaattccaagtagaacctggaacgtaccaacggacaccggccgttgtaaccttcgtggtacaggtacgaacgggcaaggtcgttacccgaggaccggggtaataaggctacggtaattcggtagtttcgggtttagaggttacgtcggtacgggtaacccggaaagtactaggtcggtaccgtacgtcgtactcgacgtaccgacaccgacggtccacgttcggtcccgtaccgtcggacctacccgtaccttaccgaacgaccgtacctacccggtacggtaccggggacctacggaccggtaccggtcccggtacggtccggtacgtaccggtcgggtaaccggaacgttacccgttaaccgttccgaccgttaaggtcccggtaaccgttacggtacggtacggtaccggtacccggg

SEQ ID NO: 70658 - DNA, 705 bp, Homo sapiens
  misc_feature: GYAE6OF02FPWK1.39.34.D01.1.454.CMB.1.raw
  modified_base (389)..(389): a, c, t, g, unknown or other
  misc_feature (389)..(389): n is a, c, g, or t
tcagtcgcactagtcacgaccggtgctcgatttagatcgtctgtgttgggtttgggggagcatcgcccagcaaccacatctgtcctctagagaatcccctgagagctccgttcctcaccatggactggacctggaggatcgtcttcttggtggcagcagtcacaggagcccagtcccaggtgaacttggtgcagtctgggtttgaggtgaagagccgtggggcctcagtgaacggtcccctgccgaggtcttctggactacatcttcagcgactattatattacacgtgggtgccgaccgtcggccccgtggaacgaacgggccgtagagtggagtgggatgtacgtaccgaaccccggagacggtcggacgaaccgaactaaaaagtntacgacgaacgaaggtaacgtaactttcggaacgggtccgaacggggtaccaaccgtagtacggaaccggtacgggaacctaccggtaacctaacgtaaccaaaaccgtcgaacccgtaacagttacggtaaacttcgtaagtacgaacgtaggaacgttaacccgaacgtaccggtaccggtaccgttacgttaccgtttacgtacggttacggacggtaaggtacggacgtaacgggtaccgttaccggtaacgggttacggggttaacgttaacgggttacggtaccggtttaacggtttacggtttaacggg

SEQ ID NO: 70659 - DNA, 329 bp, Homo sapiens
  misc_feature: GYAE6OF02HLJCH.39.34.D01.1.454.CMB.1.raw
  modified_base (286)..(289): a, c, t, g, unknown or other
  misc_feature (286)..(289): n is a, c, g, or t
  modified_base (291)..(329): a, c, t, g, unknown or other
  misc_feature (291)..(329): n is a, c, g, or t
tcagtcgcactagtcacgaccggtgctcgatttagatcgtctgtgttgggtttgggtgccgaagttgctggaggtcacggtcaccacgctgctgagggagtagagtcctgaggactgtaggacagcccatcggtccttccccctggccgccctgctccgaggagccaccctccggagagcacaggccggtccctggggctggcccttgggtaccaaagggtacctactttacccgacttaggtcgccgaatcggaaggcggggcctgggacaacgggcacagtagnnnntnnnnnnnnnnnnnnnnnnnnnnnnnnnnnnnnnnnnnnn

SEQ ID NO: 70660 - DNA, 643 bp, Homo sapiens
  misc_feature: GYAE6OF02F4OQC.39.34.D01.1.454.CMB.1.raw
  modified_base (137)..(137): a, c, t, g, unknown or other
  misc_feature (137)..(137): n is a, c, g, or t
  modified_base (267)..(267): a, c, t, g, unknown or other
  misc_feature (267)..(267): n is a, c, g, or t
tcagtcgcactagtcacgaccggtgctcgatttagatcgtctgtgttgggtttggggtgaagaagcctggggcctcagtgaaggtcccctgccaggcttctggatacatcttcagcgcctattatatacactgggtncgccaggcccctggacaagggcctgagtggagtgggatgtatcaaccccgagagtggcgacaacaaaatatgcacagagtatttcgagggcgagggtcaccatgacgtcgggacacgtccatacaaaacngaccacagtaggtaattcgagtagactagaacgtaccaacgacgaccggccgtagttacttcgtgtggcgaggaggcgtagtacgttccgacgtggggtaataaggtgacgtaagtttcgagtttggttttgagtgtcggtcggggaccgaaagggactaagtcggtaccaccggttcttcttacgacgtccctaccgaaccggtaaccggcctacgttccggttccccttccccgtcggtccctacccttccaccgtaagccgaccctaccgtcgggtaccgggctacgacggtcccggccgtggcctcgccgtacgacgtaacggtccttaaccgtcctaggtactcggtaccgtacgcggaccggcggtccgg

SEQ ID NO: 70661 - DNA, 687 bp, Homo sapiens
  misc_feature: GYAE6OF02JZ41S.39.34.D01.1.454.CMB.1.raw
  modified_base (197)..(197): a, c, t, g, unknown or other
  misc_feature (197)..(197): n is a, c, g, or t
tcagtcgcactagtcacgaccggtgctcgatttagatcgtctgtgttgggtttggggagagcatcgcccagcaaccacatctgtcctctagagaatcccctgagagctccgttcctcaccatggactggacctggaggatcgtcttcttggtggcagcagtcacgaggacgcccagtcccaggtagaacttggtgcngtacgtgggtttgaggtagaagaagccgtggggcctacgagtagaacggtccccgtgaccgacggtcttcgtggaatacgatcgtcacgccgtacttattatacgtacacgtggtcgcgccgacggcccctaggacgacggctaggacgtagagaggatagtacaccgaccgaggtcgtcggacgacaacgaaatagtacgactaacgaacgtagttatacgggacggtacgtacggtaccgacgtaggtaccggaaccggtaccgggtaaacgtacccgtaaccaacgtaacccgaaaactaccggtaaccttaacgaacgttaaacgtaaacttacgtaacgtaacgttaaccgtaacggtaacgtaacccgaaacggtacccgtaaccggtacggttacctacgttccggtaggtacgcggaacgtacggacgtaaccggtacgtaccggaggttaccgggagtaacggtacgtcgttaagttacgg

SEQ ID NO: 70662 - DNA, 813 bp, Homo sapiens
  misc_feature: GYAE6OF02JHI4B.39.34.D01.1.454.CMB.1.raw
tcagtcgcactagtcacgaccggtgctcgatttagatcgtctgtgttgggttgggggagcatcgcccagcaaccacatctgtcctctagagaactcccctgagagctccgttcctcaccatggactcggaccgtggaggtatcgtcttcgttgggtggcagcagtcacgaggcgcccgacgtcccgagggtacgtaacgttgggtcgacgtaggttccggttggggtttaggtagggtaggaaaggaacggtccggtacggggtccctacggtaggtaccggtaaaccgggtcccctacggaccggtacggtccgttacggtacggtactacctagttcctcgaacgtccgtacttaacttacgtaacgtactacggtgggtcgaccgtccggaccgccgtacggacggtacggtctacggaggtacggtaggtcggtacgtacggtactaccggaaccggtagtacggtacggaacgtaacgaaactaagtacgtacgactaagtagtacgtacgtacggaggtacacggtacacgttagacgtaccggtaccgtacgtaaccgtactaaacctaaccaaacggtaccgttaactaaccgtagtaaccgttaacgtacgtaacggtaactaacggtaacgaaccgtaacggaaacccgtacgggtaccgttccggtaacgtttaccggtccgttaaccggtacggaccggtaacgggtaacggttactaaccgggttaacgtaacccggtaaggggtaacggttacgggttaccgttaacggggtaccgtttaaacggttcgggttaacggg

SEQ ID NO: 70663 - DNA, 155 bp, Homo sapiens
  misc_feature: GYAE6OF01BQWDP.46.26.C04.1.454.CMB.1.raw
  modified_base (154)..(155): a, c, t, g, unknown or other
  misc_feature (154)..(155): n is a, c, g, or t
tcagactagcagtacacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnn

SEQ ID NO: 70664 - DNA, 154 bp, Homo sapiens
  misc_feature: GYAE6OF01E1K3Z.46.26.C04.1.454.CMB.1.raw
  modified_base (154)..(154): a, c, t, g, unknown or other
  misc_feature (154)..(154): n is a, c, g, or t
tcagactagcagtacacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagn

SEQ ID NO: 70665 - DNA, 178 bp, Homo sapiens
  misc_feature: GYAE6OF01A5WYO.46.26.C04.1.454.CMB.1.raw
  modified_base (156)..(178): a, c, t, g, unknown or other
  misc_feature (156)..(178): n is a, c, g, or t
tcagactagcagtacacgaccggtgctcgatttagtctagcgactttgggtttgggaagggtcagcggtcctaggtcagcccaaaggccaaccccactgtcactctgttcccacctcctctactgctagtctgagcgggctggcaaggcgcatagnnnnnnnnnnnnnnnnnnnnnnn

SEQ ID NO: 70666 - DNA, 154 bp, Homo sapiens; identical to SEQ ID NO: 70664
  misc_feature: GYAE6OF01BNB8U.46.26.C04.1.454.CMB.1.raw
  modified_base (154)..(154): a, c, t, g, unknown or other
  misc_feature (154)..(154): n is a, c, g, or t

SEQ ID NO: 70667 - DNA, 213 bp, Homo sapiens
  misc_feature: GYAE6OF01C2OYF.46.26.C04.1.454.CMB.1.raw
  modified_base (151)..(213): a, c, t, g, unknown or other
  misc_feature (151)..(213): n is a, c, g, or t
tcagactagcagtacacgaccggtgctcgatttagtctagcgactttgggtttggaaggtcagcgtcctaggtcagcccaaggccaacccactgtcactctgttcccgcctcctctactgctagtctgagcgggctggcaaggcgcatagnnnnnnnnnnnnnnnnnnnnnnnnnnnnnnnnnnnnnnnnnnnnnnnnnnnnnnnnnnnnnnn

SEQ ID NO: 70668 - DNA, 156 bp, Homo sapiens
  misc_feature: GYAE6OF01BV40P.46.26.C04.1.454.CMB.1.raw
  modified_base (154)..(156): a, c, t, g, unknown or other
  misc_feature (154)..(156): n is a, c, g, or t
tcagactagcagtacacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnn

SEQ ID NO: 70669 - DNA, 221 bp, Homo sapiens
  misc_feature: GYAE6OF01B4TPF.46.26.C04.1.454.CMB.1.raw
  modified_base (154)..(221): a, c, t, g, unknown or other
  misc_feature (154)..(221): n is a, c, g, or t
tcagactagcagtacacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnnnnnnnnnnnnnnnnnnnnnnnnnnnnnnnnnnnnnnnnnnnnnnnnnnnnnnnnnnnnn

SEQ ID NO: 70670 - DNA, 209 bp, Homo sapiens
  misc_feature: GYAE6OF01B5L4V.46.26.C04.1.454.CMB.1.raw
  modified_base (154)..(209): a, c, t, g, unknown or other
  misc_feature (154)..(209): n is a, c, g, or t
tcagactagcagtacacgaccggtgctcgatttagtctagcgactttgggtttgggaaggtcagcgtcctaggtcagcccaaggccaaccccactgtcactctgttcccgccctcctctactgctagtctgagcgggctggcaaggcgcatagnnnnnnnnnnnnnnnnnnnnnnnnnnnnnnnnnnnnnnnnnnnnnnnnnnnnnnnn

SEQ ID NO: 70671 - DNA, 154 bp, Homo sapiens
  misc_feature: GYAE6OF01EEYCN.46.26.C04.1.454.CMB.1.raw
  modified_base (154)..(154): a, c, t, g, unknown or other
  misc_feature (154)..(154): n is a, c, g, or t
tcagactagcagtacacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagn

SEQ ID NO: 70672 - DNA, 151 bp, Homo sapiens
  misc_feature: GYAE6OF02GS2I5.46.26.C04.1.454.CMB.1.raw
  modified_base (150)..(151): a, c, t, g, unknown or other
  misc_feature (150)..(151): n is a, c, g, or t
tcagactagcagtacacgaccggtgctcgatttagtctagcgactttgggttggaaggtcagcgtcctaggtcagcccaaggccaacccactgtcactctgttcccacctcctctactgctagtctgagcgggctggcaaggcgcatagnn

SEQ ID NO: 70673 - DNA, 207 bp, Homo sapiens
  misc_feature: GYAE6OF02GA951.46.26.C04.1.454.CMB.1.raw
  modified_base (150)..(207): a, c, t, g, unknown or other
  misc_feature (150)..(207): n is a, c, g, or t
tcagactagcagtacacgaccggtgctcgatttagtctagcgactttgggtttggaaggtcagcgtcctaggtcagcccaaggccaacccactgtcactctgttcccacctcctctactgctagtctgagcggctggcaaggcgcatagnnnnnnnnnnnnnnnnnnnnnnnnnnnnnnnnnnnnnnnnnnnnnnnnnnnnnnnnnn

SEQ ID NO: 70674 - DNA, 197 bp, Homo sapiens
  misc_feature: GYAE6OF02HQLEV.46.26.C04.1.454.CMB.1.raw
  modified_base (145)..(145): a, c, t, g, unknown or other
  misc_feature (145)..(145): n is a, c, g, or t
  modified_base (151)..(197): a, c, t, g, unknown or other
  misc_feature (151)..(197): n is a, c, g, or t
tcagactagcagtacacgaccggtgctcgatttagtctagcgactttgggtttggaaggtcagcgtcctaggtcagcccaaggccaacccactgtcactctgttcccacctcctctactgctagtctgagcgggctggcaaggcncatagnnnnnnnnnnnnnnnnnnnnnnnnnnnnnnnnnnnnnnnnnnnnnnn

SEQ ID NO: 70675 - DNA, 206 bp, Homo sapiens
  misc_feature: GYAE6OF02H59Z9.46.26.C04.1.454.CMB.1.raw
  modified_base (153)..(206): a, c, t, g, unknown or other
  misc_feature (153)..(206): n is a, c, g, or t
tcagactagcagtacacgaccggtgctcgatttagtctagcgactttgggtttgggaaggtcagcgtcctaggtcagcccaaggccaaccccactgtcactctgttcccacctcctctactgctagtctgagcgggctggcaaggcgcatagnnnnnnnnnnnnnnnnnnnnnnnnnnnnnnnnnnnnnnnnnnnnnnnnnnnnnn

SEQ ID NO: 70676 - DNA, 170 bp, Homo sapiens
  misc_feature: GYAE6OF02H44H9.46.26.C04.1.454.CMB.1.raw
  modified_base (154)..(170): a, c, t, g, unknown or other
  misc_feature (154)..(170): n is a, c, g, or t
tcagactagcagtacacgaccggtgctcgatttagtctagcgactttgggtttgggaaggtcagcgtcctaggtcagcccaaggccaaccccactgtcactctgttcccaccctcctctactgctagtctgagcgggctggcaaggcgcatagnnnnnnnnnnnnnnnnn

SEQ ID NO: 70677 - DNA, 175 bp, Homo sapiens
  misc_feature: GYAE6OF02I8B3V.46.26.C04.1.454.CMB.1.raw
  modified_base (152)..(175): a, c, t, g, unknown or other
  misc_feature (152)..(175): n is a, c, g, or t
tcagactagcagtacacgaccggtgctcgatttagtctagcgactttgggtttgggaaggtcagcgtcctaggtcagcccaaggccaacccactgtcactctgttcccacctcctctactgctagtctgagcgggctggcaaggcgcatagnnnnnnnnnnnnnnnnnnnnnnnn

SEQ ID NO: 70678 - DNA, 387 bp, Homo sapiens
  misc_feature: GYAE6OF01D8GAN.24.39.D06.1.454.CMB.1.raw
  modified_base (376)..(376): a, c, t, g, unknown or other
  misc_feature (376)..(376): n is a, c, g, or t
  modified_base (382)..(387): a, c, t, g, unknown or other
  misc_feature (382)..(387): n is a, c, g, or t
tcagactactatgtcacgaccggtgctcgatttagtgacatctcgcagtttttgggggctgtgggcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgattattactgttcaacatgggactacagcctcagttctcaggtgttcggcggagggaccaaggtgaccgtctaagtcagcccaaggctgccccctggtcactctcgttcccaccctcctcacatagtagtctgagcgggctggcaaggcncatagnnnnnn

SEQ ID NO: 70679 - DNA, 389 bp, Homo sapiens
  misc_feature: GYAE6OF01BY1AI.24.39.D06.1.454.CMB.1.raw
  modified_base (382)..(389): a, c, t, g, unknown or other
  misc_feature (382)..(389): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgattattactgttcaacatgggactacagcctcagttctcaggtgttcggcggagggaccaaggtgaccgtcctaagtcagcccaaggctgccccctggtcactctgttcccgccctcctcacatagtagtctgagcggctggcaaggcgcatagnnnnnnnn

SEQ ID NO: 70680 - DNA, 389 bp, Homo sapiens
  misc_feature: GYAE6OF01ATPVF.24.39.D06.1.454.CMB.1.raw
  modified_base (377)..(377): a, c, t, g, unknown or other
  misc_feature (377)..(377): n is a, c, g, or t
  modified_base (383)..(389): a, c, t, g, unknown or other
  misc_feature (383)..(389): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgattattactgttcaacatgggactacagcctcagttctcaggtgttcggcggagggaccaaggtgaccgtctaagtcagcccaaggctcgcccctggtcactctcgttcccaccctcctcacatagtagtctgacgcggctggcaaggcncatagnnnnnnn

SEQ ID NO: 70681 - DNA, 469 bp, Homo sapiens
  misc_feature: GYAE6OF01CY5Q7.24.39.D06.1.454.CMB.1.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (446)..(446): a, c, t, g, unknown or other
  misc_feature (446)..(446): n is a, c, g, or t
  modified_base (449)..(469): a, c, t, g, unknown or other
  misc_feature (449)..(469): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctctgctcagggatccctgaccgtcttctctggctcaaggtctgggaccacagcccttccctgtattatccgtcggcctccagtctggaggacgaggctgtattatactgttacaacntgggactacgngcctcagtttcctgtaggttgttccgggacggtacgggaaccgtaaggtcgtacccgttacctaacggtcgacgacccgaacggcctccgcccccgtgtccacctctcgttcccccacctccctacactagttacggtactctcggacggcggacgtgggaaccaacgggtcgactagtacggntcnnnnnnnnnnnnnnnnnnnnn

SEQ ID NO: 70682 - DNA, 477 bp, Homo sapiens
  misc_feature: GYAE6OF01D3Y3O.24.39.D06.1.454.CMB.1.raw
  modified_base (442)..(477): a, c, t, g, unknown or other
  misc_feature (442)..(477): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctctgctcagggatccctgaccgcttctctggctcaaggtctgggaccacagcctccctgattatcgtcgggcctccagtctgaggacgaggctgtattattactgttacaaactagtgggactacacgcctcagttctctaggtggttcggcgggaggactaggtctaggaccgtccgtaggtccacgacccaaggcctccgccccctcggtcacttcgtcccgttcccgacccttcctaccgtaactacgtagtacgtcgtaggacggtccgggcgtagggacgaaacgggccgacgtaagagtcgnnnnnnnnnnnnnnnnnnnnnnnnnnnnnnnnnnnn

SEQ ID NO: 70683 - DNA, 386 bp, Homo sapiens
  misc_feature: GYAE6OF02F8MF7.24.39.D06.1.454.CMB.1.raw
  modified_base (382)..(386): a, c, t, g, unknown or other
  misc_feature (382)..(386): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgattattactgttcaacatgggactacagcctcagttctcaggtgttcggcggagggaccaaggtgaccgtcctaagtcagcccaaggctgccccctggtcactctgttcccgcctcctcacatagtagtctgagcgggctggcaaggcgcatagnnnnn

SEQ ID NO: 70684 - DNA, 401 bp, Homo sapiens
  misc_feature: GYAE6OF02IW51I.24.39.D06.1.454.CMB.1.raw
  modified_base (253)..(253): a, c, t, g, unknown or other
  misc_feature (253)..(253): n is a, c, g, or t
  modified_base (381)..(381): a, c, t, g, unknown or other
  misc_feature (381)..(381): n is a, c, g, or t
  modified_base (387)..(401): a, c, t, g, unknown or other
  misc_feature (387)..(401): n is a, c, g, or t
tcagactactatgtcacgaccggtgctcgatttagtgacatctcgcagttctttgggggctgtgggcttaggaagcagagcctgggggcatctccaccatggcctggacccctctcctcctccagcttctcaccctctgctcagggatccctgaccgcttctctggctcaaggtctgggaccacagcctccctgattatctcgggcctccagtctgaggacgaggctgattatactgttcaacatgggactanagcctcagttctcaggtgttcggcggagggaccaaggtgaccgtctaagtcagcccaaggctcgcccccgtggtcactcgtcgttcccacctcctcacatacgtagtctgacgcggactggcaaggcncatcgnnnnnnnnnnnnnnn

SEQ ID NO: 70685 - DNA, 386 bp, Homo sapiens
  misc_feature: GYAE6OF02HMENZ.24.39.D06.1.454.CMB.1.raw
  modified_base (380)..(386): a, c, t, g, unknown or other
  misc_feature (380)..(386): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgattattactgttcaacatgggactacagcctcagttctcaggtgttcggcggagggaccaaggtgaccgtcctaagtcagcccaaggctgcccctggtcactctgttcccacctctcacatagtagtctgagcgggctggcaaggcgcatagnnnnnnn

SEQ ID NO: 70686 - DNA, 405 bp, Homo sapiens
  misc_feature: GYAE6OF02IFN2E.24.39.D06.1.454.CMB.1.raw
  modified_base (392)..(405): a, c, t, g, unknown or other
  misc_feature (392)..(405): n is a, c, g, or t
tcagactactatgtcacgaccggtgctcgatttagtgacatctcgcagttctttggggggctgtgggcttaggaagcagagcctggggcatctccaccatggcctggaccccctctcctcctccagcttctcaccctctgctcagggatccctgaccgcttctctggctcaaggtctgggaccacagccctcctgattatcgtcgggcctccagtctgaggacgaggctgattattactgttcaacagtgggactacagcctcagttctcaggttgttcggcggagggaccgaaggtgacccgtctaagtcacgcccaaggctcgcccctcggtcactctcgtcccacctcctcacatagtagtctgagcggcgtggacaggcgacagtagnnnnnnnnnnnnnn

SEQ ID NO: 70687 - DNA, 578 bp, Homo sapiens
  misc_feature: GYAE6OF02JW5Z3.24.39.D06.1.454.CMB.1.raw
  modified_base (136)..(136): a, c, t, g, unknown or other
  misc_feature (136)..(136): n is a, c, g, or t
  modified_base (531)..(532): a, c, t, g, unknown or other
  misc_feature (531)..(532): n is a, c, g, or t
  modified_base (534)..(534): a, c, t, g, unknown or other
  misc_feature (534)..(534): n is a, c, g, or t
  modified_base (537)..(540): a, c, t, g, unknown or other
  misc_feature (537)..(540): n is a, c, g, or t
  modified_base (542)..(578): a, c, t, g, unknown or other
  misc_feature (542)..(578): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctntgctcagggatccctgaccgcttctctggctcaaggtcgtgggaccacagcctccctgacttatccgtccgggccctccagtctggaggacgaggctgtattattactgttacaactgtcgggactacgagcctcgtacgttctcgtaacggttcggttcgggccgggaacgggaaccgaagggtcgacccggtaccgtaacggttccacggtaccccgaacgggtccgtccggtcccccccgttcgggtacctaccgtttaccgttcccggttcccccgcccccgttcccttacccgaaccgtaactttaccggttacggttaccgttacggtaacggggtccgggtcggtacggggtaccgtaaacgggccgaccgtaagtacggctagtacnncncgnnnngnnnnnnnnnnnnnnnnnnnnnnnnnnnnnnnnnnnnn

SEQ ID NO: 70688 - DNA, 497 bp, Homo sapiens
  misc_feature: GYAE6OF02JGHQY.24.39.D06.1.454.CMB.1.raw
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (462)..(497): a, c, t, g, unknown or other
  misc_feature (462)..(497): n is a, c, g, or t
tcagactactatgtcacgaccggtgctcgatttagtgacatctcgcagttctttgggggcgtgtgggcttaggaaggcagagcctggggcgagtctccaccatggcctggacccctctcctcctccagcttctcaccctctcgctcagggactccctgaccgcttctctggcctcgagtctgggaccagacgcctccctgattactctcgggtcctccgagtctgacggacgaggctgattatacgttgtcaacagtggactacgagcctcagttctcgaggtgttcggacggaggaccaaggtcgacccgtcgaagtcacgcccgaaggctacggccccctcgggtacacgttccgtcgttcccctacccgtcctaccactagtacgtcgttctggacggtccgggcttacggggaccaacgggtacgctaaggtcgactcgganagtnagnagntcgtcnnnnnnnnnnnnnnnnnnnnnnnnnnnnnnnnnnnn

SEQ ID NO: 70689 - DNA, 412 bp, Homo sapiens
  misc_feature: GYAE6OF02G2OTE.24.39.D06.1.454.CMB.1.raw
  modified_base (392)..(395): a, c, t, g, unknown or other
  misc_feature (392)..(395): n is a, c, g, or t
  modified_base (397)..(412): a, c, t, g, unknown or other
  misc_feature (397)..(412): n is a, c, g, or t
tcagactactatgtcacgaccggtgctcgatttagtgacatctcgcagttctttggggggctgtgggcttaggaagcagagcctggggcatctccaccatggcctggacccctctcctcctccagcttctcaccctctgctcagggatccctgaccgcttctctggctcaaggtctgggaccacagcctcctgattatcgtcgggcctccagtctgaggacgaggctgattattactgttacaacagtggactacagcctcagttctcaggtgttcggcggagggactaggtgaccgtctaagtcagcccgaaggctcgccccgtcggtcactcgtcgttcccgccctcctcacatagtacgtctgacgcggcgtggacgaggcgcagtcgnnnngnnnnnnnnnnnnnnnn

SEQ ID NO: 70690 - DNA, 391 bp, Homo sapiens
  misc_feature: GYAE6OF02FJVUW.24.39.D06.1.454.CMB.1.raw
  modified_base (383)..(391): a, c, t, g, unknown or other
  misc_feature (383)..(391): n is a, c, g, or t
tcagactactatgtcacgaccggtgctcgatttagtgacatctcgcagttctttgggggctgtgggcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgattattactgttcaacatgggactacagcctcagttctcaggtgttcggcggagggaccaaggtgaccgtcctaagtcagcccaaggctgccccctggtcactctgttcccgccctctcacatagtagtctgacgcgggctggcaaggcgcatagnnnnnnnnn

SEQ ID NO: 70691 - DNA, 354 bp, Homo sapiens
  misc_feature: GYAE6OF02GG2G8.37.24.C02.1.454.CMB.1.raw
  modified_base (354)..(354): a, c, t, g, unknown or other
  misc_feature (354)..(354): n is a, c, g, or t
tcagtagtgtagatcacgaccggtgctcgatttagtacagatcgttagggaaaggggttggcgtagccactcactccctctctcgcacagtctatgtggagttgagaagcctgagatctgacgacacggccatttattactgtgcgagagagggagtgagtggctacgccaacccctttgactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagn

SEQ ID NO: 70692 - DNA, 354 bp, Homo sapiens
  misc_feature: GYAE6OF02GCDU7.37.24.C02.1.454.CMB.1.raw
  modified_base (353)..(354): a, c, t, g, unknown or other
  misc_feature (353)..(354): n is a, c, g, or t
tcagtagtgtagatcacgaccggtgctcgatttagtacagatcgttagggaaaggggttggcgtagccactcactccctctctcgcacagtctatgtggagttgagaagcctgagatctgacgacacggccatttattactgtgcgagagagggagtgagtggctacgccaacccctttgactactggggccagggaaccctggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcatagnn

SEQ ID NO: 70693 - DNA, 419 bp, Homo sapiens
  misc_feature: GYAE6OF02G4EH0.37.24.C02.1.454.CMB.1.raw
  modified_base (296)..(296): a, c, t, g, unknown or other
  misc_feature (296)..(296): n is a, c, g, or t
  modified_base (375)..(419): a, c, t, g, unknown or other
  misc_feature (375)..(419): n is a, c, g, or t
tcagtagtgtagatcacgaccggtgctcgatttagtacagatcgttaggggaaagggggttggcgtagccactcactccctctctcgcacagtctatgtggagttgagaagcctgagatctgacgacacggcatttattactgtgcgagagagggagtgagtggctacgccaacccctttgactacgtggggccagggaaccctggtcaccgtctcctcagcctcaccgaaggcccatcgtccttcccctgccaccctcctacaagacgcacctcgtggggcaacaggccggcccngggctgcctggtcaaaggaccttacttccatcctaacactacgtgaggccgggacgtggacgaaggcgacaacgtagcnnnnnnnnnnnnnnnnnnnnnnnnnnnnnnnnnnnnnnnnnnnnn

SEQ ID NO: 70694 - DNA, 402 bp, Homo sapiens
  misc_feature: GYAE6OF02FOYRG.37.24.C02.1.454.CMB.1.raw
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (340)..(340): a, c, t, g, unknown or other
  misc_feature (340)..(340): n is a, c, g, or t
  modified_base (362)..(402): a, c, t, g, unknown or other
  misc_feature (362)..(402): n is a, c, g, or t
tcagtagtgtagatcacgaccggtgctcgatttagtacagatcgttagggaaaggggttggcgtagccactcactccctctctcgcacagtctatgtggagttgagaagcctgagatctgacgacacggccatttattactgtgcgagagagggagtgagtggctacgccaaccctttgactactgggccagggaaccctggtcaccgtncctnagcctccaccaagggcccatcggtccttcccctggccacccttcctccaaagagccaacctctgggggcacagcgccctgggctgcctggtcaaggactacttccatctacactactgacgcgggngtggcaaggcgtcgatacggannnnnnnnnnnnnnnnnnnnnnnnnnnnnnnnnnnnnnnnn

SEQ ID NO: 70695 - DNA, 416 bp, Homo sapiens
  misc_feature: GYAE6OF01COKQJ.36.61.F06.1.454.CMB.1.raw
  modified_base (411)..(416): a, c, t, g, unknown or other
  misc_feature (411)..(416): n is a, c, g, or t
tcagtacgctgtctcacgaccggtgctcgatttagctacgctctaagggaaaggggctggagtgggtggccaacataagacaagatggaagtaggaaagaatatgtggactctgtgaagggccggttcagcatctccagagacaacgccaagaactccgtggatctgcaaatggacagtctgagagccgaggacacggctgtctattactgcgcgagagaaggagtgggcggtttcgactactggggccaggggagccctggtcaccgtctcctcagcctccaccaagggcccatcggtcttccccctggcgccctgctccaggagcacctccgagagcacagcggccctggctgcctggtcaaggactacttccagacagcgtactgagcgggctggcaaggcgcatagnnnnnn

SEQ ID NO: 70696 - DNA, 469 bp, Homo sapiens
  misc_feature: GYAE6OF01DT5WG.36.61.F06.1.454.CMB.1.raw
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (440)..(469): a, c, t, g, unknown or other
  misc_feature (440)..(469): n is a, c, g, or t
tcagtacgctgtctcacgaccggtgctcgatttagctacgctctaagggaaaggggctggagtgggtggccaacataagacaagatggaagtaggaaagtaatatgtggactctgtgaagggccggttcagcatctccagagacaacgccaagaactccgtggtatctgcaaattggacagtctgagagccgaggacacggctgtctattactgcgcgagagaaggagtgggcgtttcgactacgtggggccagggctcccgtggtcaccggtctccctcacgccctccaccaagggccccatccggtcttcccccgtggccgcccctcgctcccaggagcacctcgagngcacagcgaccnggctgcctggtacaaggtcctacttacccagtacacgtccgtactgacgccggctcggacaagggccgcaatacggannnnnnnnnnnnnnnnnnnnnnnnnnnnnn

SEQ ID NO: 70697 - DNA, 414 bp, Homo sapiens
  misc_feature: GYAE6OF01CIIQ6.36.61.F06.1.454.CMB.1.raw
  modified_base (256)..(256): a, c, t, g, unknown or other
  misc_feature (256)..(256): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (406)..(414): a, c, t, g, unknown or other
  misc_feature (406)..(414): n is a, c, g, or t
tcagtacgctgtctcacgaccggtgctcgatttagctacgctctaagggaaggggctggagtgggtggccaacataagacaagatggaagtaggaaagaatatgtggactctgtgaagggccggttcagcatctccagagacaacgccaagaactccgtggatctgcaaatggacagtctgagagccgaggacacggctgtctattactgcgcgagagaaggagtgggcggtttcgactacgtggggccagggganccctggtcaccgtctcctcagcctccaccaagggcccatcggtctcccctggcgccctgctccaggngcacctccganagcacagcgcctggctgcctggtcaaggactacttccagacagcgtactgagcggctggcaaggcgcatagnnnnnnnnn

SEQ ID NO: 70698 - DNA, 430 bp, Homo sapiens
  misc_feature: GYAE6OF02HR87S.36.61.F06.1.454.CMB.1.raw
  modified_base (423)..(430): a, c, t, g, unknown or other
  misc_feature (423)..(430): n is a, c, g, or t
tcagtacgctgtctcacgaccggtgctcgatttagctacgctctaagggaaggggctggagtgggtggccaacataagacaagatggaagtaggaaagaatatgtggactctgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaacccctggtcaccgtctcctcagcctccaccaagggcccatcggtcttccccctggcaccctcctccaagagcacctctggggcacagcggccctgggctgcctggtcaaggactacttccagacagcgtactgagcgggctggcaagggcgcatagnnnnnnnn

SEQ ID NO: 70699 - DNA, 414 bp, Homo sapiens
  misc_feature: GYAE6OF02H1REA.36.61.F06.1.454.CMB.1.raw
  modified_base (409)..(414): a, c, t, g, unknown or other
  misc_feature (409)..(414): n is a, c, g, or t
tcagtacgctgtctcacgaccggtgctcgatttagctacgctctaagggaaggggctggagtgggtggccaacataagacaagatggaagtaggaagaatatgtggactctgtgaagggccggttcagcatctccagagacaacgccaagaactccgtggatctgcaaatggacagtctgagagccgaggacacggctgtctattactgcgcgagagaaggagtgggcggtttcgactactggggccaggggagccctggtcaccgtctcctcagcctccaccaagggcccatcggtcttcccctggcgccctgctccaggagccacctccgagagcacagcggccctggctgcctggtcaaggactacttccagacagcgtactgagcgggctggcaaggcgcatagnnnnnn

SEQ ID NO: 70700 - DNA, 419 bp, Homo sapiens
  misc_feature: GYAE6OF02HDX3K.36.61.F06.1.454.CMB.1.raw
  modified_base (268)..(268): a, c, t, g, unknown or other
  misc_feature (268)..(268): n is a, c, g, or t
  modified_base (409)..(419): a, c, t, g, unknown or other
  misc_feature (409)..(419): n is a, c, g, or t
tcagtacgctgtctcacgaccggtgctcgatttagctacgctctaagggaaagggctggagtgggtggccaacataagacaagatggaagtaggaaagaatatgtggactctgtgaagggccggttcagcatctccagagacaacgccaagaactccgtggatctgcaaatggacagtctgagagccgaggacacggctgtctattactgcgcgagagaaggagtgggcggtttcgactactggggccagggagccctggtcaccgtntcctcagcctccaccaagggcccatcggtcttccccctggcgccctgctccaggagcacctccgagagcacagcggccctggctgcctggtcaaggactacttccagacagcgtactgagcgggctggcaaggcgcatagnnnnnnnnnnn

SEQ ID NO: 70701 - DNA, 587 bp, Homo sapiens
  misc_feature: GYAE6OF02I3PWF.36.61.F06.1.454.CMB.1.raw
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
  modified_base (526)..(527): a, c, t, g, unknown or other
  misc_feature (526)..(527): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
  modified_base (565)..(565): a, c, t, g, unknown or other
  misc_feature (565)..(565): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
tcagtacgctgtctcacgaccggtgctcgattttagctacgctctaagggaaggggtcggtggagtgggtggccaacataagacaaggatggaagtaggaaagaatatgtggactctgtgaagggccggttcagcatctccagagacaacgccaagaactccgtgatctgcaaatggacagtctgagagccggaggacacggctgtctattactgcgcgagagaaggagtgggcgtttcgactacgtggggccaggggagcccgttggtccaccgttctcctcagccctccaccgaacggcccagtccggtacctttcccccgtggccgccctgcctccgagggacgaccacctccggacgacgcacgacgccggcccctgggtcctcggtaccgtggtaccgaaagggtccttaacgttacccaacggaccctacgggtccgttaaccgtcggaacgggtccggggtccgtaggggacctaaacggggccgaccgaagttaggagcgcgngtgtgctgctancgnnangngngngtgtcgcncgtcgtncgtgcgcgacncgcncgtcgngcgngcncgcgcgtcg

SEQ ID NO: 70702 - DNA, 464 bp, Homo sapiens
  misc_feature: GYAE6OF02F4U08.36.61.F06.1.454.CMB.1.raw
  modified_base (442)..(464): a, c, t, g, unknown or other
  misc_feature (442)..(464): n is a, c, g, or t
tcagtacgctgtctcacgaccggtgctcgatttagctacgctctaagggaaggggctggagtgggtggccaacataagacaagatggaagtaggaaagaatatgtggactctgtgaagggccggttcagcatctccagagacaacgccaagaactccgtggatctgcaaatggacagtctgagagccgaggacacggctgtctattactgcgcgagagaaggagtgggcgtttcgactacgtggggccaggggacgccctggtcaccgtctcctcagcctccaccgaggcccatcggtcttccccctggccgccctgcctccaggacgccacctcccgagacgcacaggccggcccctgggcctgcctggtacaaacggacttaccttaccagaccaggtccgtacgtggaggccgggactgggacaagggccgacagtagnnnnnnnnnnnnnnnnnnnnnnn

SEQ ID NO: 70703 - DNA, 551 bp, Homo sapiens
  misc_feature: GYAE6OF01BHA2U.52.74.G08.1.454.CMB.1.raw
  modified_base (428)..(428): a, c, t, g, unknown or other
  misc_feature (428)..(428): n is a, c, g, or t
  modified_base (480)..(480): a, c, t, g, unknown or other
  misc_feature (480)..(480): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagcccccggaagggctggagtggatcggcagcatccatcatagtgagacaataatcacaatccgtccctcagaggacgagtcaccttttcagtgagacgtcaagaccatctccctgaattgactctctcgaccgcgccgacacggtccctttatacagtgcgcgagtnaacacagcaatacttatacttgtagtaatatcggggcctagggaaccccgtnacccgtagtactcccgttacacgtcccttacccgaacccgacgggaccctacgtccggtcccttcccccgg

SEQ ID NO: 70704 - DNA, 605 bp, Homo sapiens
  misc_feature: GYAE6OF01DKP8S.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggatggttattattgggcctggatccggcagcccccgggaagggctggagtggatcggcagcatccagtcatagtggagacaataatcacaatccgtcctcagagacgagtcacttttcagtgagacgtcaagaaccaattctccctagaattgacctctctcgaccgccgccgacacggccctttatactgtgcgcgagtgaactacagcaaatacttaattatacgtttagaaattagttacggggacccgtaacggggtaaacccccggtacgtaacccgtacgttaccctacccgtctaaccggtccccttaccccgaacccgtaaaccggggtaccccacgttcccgggtcccgttttaccccccccggg

SEQ ID NO: 70705 - DNA, 560 bp, Homo sapiens
  misc_feature: GYAE6OF01BXF8Q.52.74.G08.1.454.CMB.1.raw
  modified_base (480)..(480): a, c, t, g, unknown or other
  misc_feature (480)..(480): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagccccccgggaaggggctggagtggatcggcagcatccatcatagtggagacaataatcacaactccgtccctcagaggacgagtctacctttcagtggacgaccgtcaagaaccaattcctaccctagtaacttcgaccttctccgtcgacccgcccgcccgacaccggtccctttatactgtgcgcgatgaacacagctaataacttattatgttanaatagtgggccacgggtaccccgtcacccgtatctccctcacgccctccgaccacggccccagtcccggtccttcccccg

SEQ ID NO: 70706 - DNA, 633 bp, Homo sapiens
  misc_feature: GYAE6OF01D2OG4.52.74.G08.1.454.CMB.1.raw
  modified_base (333)..(333): a, c, t, g, unknown or other
  misc_feature (333)..(333): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctggagaccctctcactcacctgcaatgtctctggatattcaattgggagtggttattatgggcctggatccggcacggcccccgggaagggctggagtggatcggcagcatccatcagtagtggagacaataatcacaatccgtccctnagaggacgagtctactttcagtgagacgtcaagacaattctaccctagaattcgaccttctctacgacccgccgaccgtaccgaccggtccctttattactgtcgccgtcgacgttagaacacgagactaaattaacctttaattacgttagttagtaacgttagtttcgggggaccctaaccggggtaacccccgtcgaaccccgtaacttcccttacccgtaccgaccgtaccccttaccccgaacccggtaaacgggacccccctaggtttccccggtccccgtttacccccccggg

SEQ ID NO: 70707 - DNA, 570 bp, Homo sapiens
  misc_feature: GYAE6OF01DY2O8.52.74.G08.1.454.CMB.1.raw
  modified_base (337)..(337): a, c, t, g, unknown or other
  misc_feature (337)..(337): n is a, c, g, or t
  modified_base (444)..(444): a, c, t, g, unknown or other
  misc_feature (444)..(444): n is a, c, g, or t
  modified_base (456)..(456): a, c, t, g, unknown or other
  misc_feature (456)..(456): n is a, c, g, or t
  modified_base (480)..(480): a, c, t, g, unknown or other
  misc_feature (480)..(480): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggatggttattattgggcctggatccggcacggcccccgggaaggggctggagtggatcggcagcatccatcatagtggagacaataatcacaactccgtaccctanagaggacgagtctactttgagtggagacgtacaagaacctaattcctaccctagtaaacttcgaccttctactcgaccgccgccgacgaccgtcctttatactgtcncgcgagtgaacncagctaattacttattatagttanaagttgtcgggacctacgggtaccccgtacacctacgtcctacctcacgccctaccgaccgacgggccctacgtccgtcccgttccccgg

SEQ ID NO: 70708 - DNA, 698 bp, Homo sapiens
  misc_feature: GYAE6OF01CIZLS.52.74.G08.1.454.CMB.1.raw
  modified_base (151)..(151): a, c, t, g, unknown or other
  misc_feature (151)..(151): n is a, c, g, or t
  modified_base (180)..(180): a, c, t, g, unknown or other
  misc_feature (180)..(180): n is a, c, g, or t
  modified_base (320)..(320): a, c, t, g, unknown or other
  misc_feature (320)..(320): n is a, c, g, or t
tcagcgcagtacgacacgaccggtgctcgatttagtagctctatcaggggggtctttctgagagtcatggacctcccgcgcaagaacatagaagcacctgttggtttttcctcctgctggtgacagctcccaggagggtcctgtccaggtncgagctccaggagtccgggcccgataagngaacgcccgtggacgacctctcactcacctgaccatcgctgtgatattagaagttgggtatggttattaggttcggccttggacgtccggacaccgggacccccgggaagggccgtagggacgtacgggaagtccggganacggcgtacgtaccgaagtacaaggttaggaggaagaacctaataactacgaactaaaccgtccccggtacctacggaacgacggacctacggttactaaccgttttacgagtacggaacgtaaccgtaccaaagtaaccctattacccgtaccgtaagtaccttacgtacctcgtacgtccgacccgccacccgtaacaccggttcctttagtactggtcgaccgtgacgtacgacaacgcgtaactaagttacttaagtgtttatacggactttacgggacggaacccgtaacgggacccgacgtaaccgtcgttccacctacgaccgtacccctacgaaccgtacggaccctcgtaccccgttccgtacccccgg

SEQ ID NO: 70709 - DNA, 671 bp, Homo sapiens
  misc_feature: GYAE6OF01AZ68C.52.74.G08.1.454.CMB.1.raw
  modified_base (359)..(359): a, c, t, g, unknown or other
  misc_feature (359)..(359): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaagttgggagtggttattagttgggcctggatccggcacggccccccgggaagggctggagtggatcggcagcatccatcatagtggagacaataatcacaatccgtccctcgagaggacgagtctaccttttnacgtggagacgtaccaacgaaacctacgtttcctaccctagaaactttcggaaccctcttcgtaccgaccccgccgtaccccggaacgtacccggtaccccttttaataccttggtacgccggtacgtacggcgaacacacgacaactttaacgttattaagttgttacgttaatagggtttcgggacccgtaacggggttaacccccgtctaacccgtacgttcccttaccccgtacgtaacccgtcccctaccccggtaaccgaaaccgggtccccctacgttccccgggttcccgtttccccccccggg

SEQ ID NO: 70710 - DNA, 627 bp, Homo sapiens
  misc_feature: GYAE6OF01BKI0K.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggcccccggactaatgaagccctcggagaccctctcactcacctgcaatgtctctggatattcaattgggagtggttattattgggcctggatccggcacggccccccgggaaggggctggagtggatcggcagcatccatcatagtggagacaataatcacaactccgtccctcagacggacgagtcctaccttttcaggtggacgtaccgtaccaaacgaaaccctaacttcctaccctagaaactttcgacccttctctcgacccgcccgacccgacaccggtccctttatactgtcgcgtcgagtacgaacacgacgactaaacttaactttaattattagttagtaagttacggttacggggacccgaacggggtaacccccgtcaacccgtatccctccctcgaccgtccctacccgaacccgacgggaccccacgttcccggttccccttcccccgg

SEQ ID NO: 70711 - DNA, 754 bp, Homo sapiens
  misc_feature: GYAE6OF01BZXUL.52.74.G08.1.454.CMB.1.raw
  modified_base (215)..(215): a, c, t, g, unknown or other
  misc_feature (215)..(215): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccaggaggggtcctgtcccaggtgcagctccaggagtcgggccccggataatgaagccctcggagaccctctcactcacctgcaatgtcnctgatattcaagttgggagtggttattagttgggcctggactccggcacggcccccgggaagggctggagtggagtcggcagcatccatcataggtggagaactaataactcaactaactcccgtaccctacgaggaacggacgtacgttcctaccgttttacgaggtacggaacgtaccgtaccgtaaaacgtaacctaacgtttcctacccgtaagtaaactttcgaccctttactaccgttcgaaccccggcccgtaacccgaaccgtacccggttacccttttaacgttaccgttcgtcggaccggtcgtaacgtacgtaaccacgaacgtaacttaaacgttaaactttaagtttagttacgttaagttaacgttaacggttccggggtaacccgtaaccgggggtaacccccgttaaccgacccgttaacctcccgttaccccgtaccacccgggttaaccccaccccggtaaaccggtaaccccgggtacccttaaaccgggttcccccgggttaccccttcccccccgggg

SEQ ID NO: 70712 - DNA, 695 bp, Homo sapiens
  misc_feature: GYAE6OF01CEHEM.52.74.G08.1.454.CMB.1.raw
  modified_base (534)..(534): a, c, t, g, unknown or other
  misc_feature (534)..(534): n is a, c, g, or t
tcagcgcagtacgacacgaccggtgctcgatttagtagctctatcagggggctttctgagagtcatggacctcccgcgcaagaacatgaagcacctgtggttttttcctcctgctggtgacagctcccagaggggtcctgtcccaggtgcagctccaggagtcggggccccggactaatgaacgcccctcggacgaccctctcactcacctgcaatgtctctggattattcaagttgggagttggtttattagttcgggcctggactccggcacggcccccgggaaggggctggagtggagtcggcagcacgtccatcagtagtggagacaataacacactactcccgtactacgagacggacgtacgtacctttacgttacgtaggtacggaccgtaaccgaacgaaaccgtaacttaccttcccttacgtaaacgttacgttacctacccgtacgttcgaccccggaccgcccgacccgaccgtacccgtttaactttaccgttacgtcgtcgaccgcggtacgaacgacanacgtaactaactttaactttagttagttaagttagttaacggttacgggtaccgggtacccggaacccgggtaccctaccgtacgtccttaccctcgtccacccgtacccaacccgtaccggacccgtaccgtaccgttccccggttaccccgtccccggg

SEQ ID NO: 70713 - DNA, 685 bp, Homo sapiens
  misc_feature: GYAE6OF01EPCIR.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagttggttattagttgggctggatccggcacggcccccgggaagggctggagtggagtcggcagcactccgatcagtaggtggagacaataactacaacaactcccgtccctacgaggacggacgacgtcctacctttcgaggtaggacgaccgtaccaaacgaaacctaacgtttcctacccttagtaaacttcgtaccttcctctacgacccgcccgacccgaccgtaccggtcccttttaacttacgtgtcgtacgcgtacgtcgaacacgacgactaaacttaatttaattagttagttagtaagttacgggttaccggggaacccgtaaccggggtaaacccccggttaccaacccgtaccgttaccctacccgtccgtaccgtaccccgtaacccgtaacccggaaccgggtacccctacgttcccggttaccccgttccccccggg

SEQ ID NO: 70714 - DNA, 782 bp, Homo sapiens
  misc_feature: GYAE6OF01CUQRX.52.74.G08.1.454.CMB.1.raw
  modified_base (108)..(108): a, c, t, g, unknown or other
  misc_feature (108)..(108): n is a, c, g, or t
tcagcgcagtacgacacgaccggtgctcgatttagtagctctatcagggggctttctgagagtcatggacctcccgcgcaagaacatgaagcacctgtggtttttccncctgctggtgacagctcccaggaggggtcctgtcccaggtgcagctccgaggagtccgggacccgactaatgaacgcccgtcggacaccctctcactcacctgcatgtctcgtggattatctaagttgggagttggttattagttcgggcctggacgtccggcgacggccccggggagggctggaggtggagtcggcagcactcatcagtagcgagacaatactacaactaactcccgtactcgacggaacggtacgtacgttaccgtacccgttttagaacggttacggaacggtaacccggtaacctaaaacggtaaacctaacgtttacccgtacccgttaaagtaaacgtttacgaaccctttcgtaccggttccggaccccggtaccccggacccgtaaccgtaacccggttacccctttttaaagtccgtttacggtacggtccgtacggtacggtaaccgaactaaccgtaacgtacctaaaacgtttacgttttaacttagttaacggttaagtaagttacgggttcggggtaccctaaccggggaaccccgttaccgaaccgttccgttacccgttcccgtaccgtaccccggtaccccgtacccgaaacccggttaacccggacccgtttacccgttccccgggttccccgttaaccccccggg

SEQ ID NO: 70715 - DNA, 761 bp, Homo sapiens
  misc_feature: GYAE6OF01A347Q.52.74.G08.1.454.CMB.1.raw
  modified_base (331)..(331): a, c, t, g, unknown or other
  misc_feature (331)..(331): n is a, c, g, or t
tcagcgcagtacgacacgaccggtgctcgatttagtagctctatcaggggcgtttctgagagtcatggacctcccgcgcaagaacatgaagcacctgtggttttcctcctgctggtgacagctcccaggaggggtcctgtcccaggtgcagctccaggagtcgggccccggactaatgaagccctcggagaccctctcacctcacctgcaatgtctctggatattcaattggggatggttattatgggcctggatccggcacggcccccgggaagggctggagtggacgtcggcaggcatccgaatcatacggtgaagacaataatccaanaacttacccgtcccctacgaaggtaccggacgtaaacgttccgtaaccgtttttacgacggttagggaacgtacccgttaacgaaacgaaacccctaaacgtttcctaccccgttagtaaacgtttcggaaacccttcgttacctaacgggtaccccgacccgacccggtaacgtacccgggttccccttttaagtccgttacgtccggacggtaccgaggttacgaaactaacgacgtacttaaaacgttaccgtttaaatttacgtacgtttaagtaaacgtttacggtaccgggggttaccaaacccgggtaacccccgggttacaaaccgtacttcccgttaaccgttccaaaccggtacccctacccgtaaacccgggaaacccgggaccctttccggtaccccgggttcccttacccccccggg

SEQ ID NO: 70716 - DNA, 741 bp, Homo sapiens
  misc_feature: GYAE6OF01EG2WR.52.74.G08.1.454.CMB.1.raw
  modified_base (199)..(199): a, c, t, g, unknown or other
  misc_feature (199)..(199): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccaggaggggtcctgtcccaggtgcagctcaggacgtcgggccccggactaatgaacgccctcggacgaccctntcactcacctgcaatgtctctgatattcaagttggagtgttattagtgggcctggatccggcacggcccccggggaagggcgtggagtggatcggcagcacgtccatcagtaggtggagaacaataatcaactaactccgtaccctacgagtaacggacgtacgtcctaaccgttttacgacgttacggaacgtaccgtaccaaacggtaaaccctaaacgtttacccgttaaccctaggtaaaactttccgtaaccgttccttaccgtacggaccccgtcccggaccccgtaaccgtacccggttacccttttaacgttaccttcggtcggtaccgtacgtacggttacgaaaccgtacgaacggtaacctaaacgttaacgtttaatttagtttacgttaggttaaacttacggttacggggtaccggtaaaccgggaaccccggttacctaaccgtaccttccttacccgtacgtaccgtaccccgaacccgtaaccggaaccggtacccctaacgttcccggttcccgttacccccgg

SEQ ID NO: 70717 - DNA, 593 bp, Homo sapiens
  misc_feature: GYAE6OF01EOS8J.52.74.G08.1.454.CMB.1.raw
  modified_base (361)..(361): a, c, t, g, unknown or other
  misc_feature (361)..(361): n is a, c, g, or t
  modified_base (459)..(459): a, c, t, g, unknown or other
  misc_feature (459)..(459): n is a, c, g, or t
  modified_base (520)..(520): a, c, t, g, unknown or other
  misc_feature (520)..(520): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccagggacgtcgggccccggataatgaagccctcggacgaccctctcactcacctgcaatgtctctggatattcaatttgggatggttattagttggggcctggatccggcacggcccccgggaagggctggagtggatcggcagcatccatcatagtggagacaataatcaacaactccgtccctgagaggacgagtcaaccttttnagtggagacgtaccaagaaacctacttctaccctagaaacttgacctctctgacccgccgccgacaccggtcctttatacgtgtgccgcgagtgaacncagcaatactatatgttagaattacggttgggaccgaacgggtacccccggtacacccgtntcccttaccgtccacggtcccctacccgaaccgaacgggaccccaacgttccccgggtcccttaccccccggg

SEQ ID NO: 70718 - DNA, 687 bp, Homo sapiens
  misc_feature: GYAE6OF01CI8ZK.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccaggaggggtcctgtcccaggtgcagctccaggagtccgggccccgataatgaacgccctcggagaccctctcactcacctgcaatgtctcgtgactattcaagttgggagttggttaattagttcggccttggactccggcacggacccccgggaagggcgtggagtggatcggcagcatccgatcagtagtaggagaacaaataactcaacgtaactcccgtacctacgaacgaggaccgtacggtccttaacccgttttcgaggttacggaagtaccggtaaccaaacgaaccctaaagttcccttaccgtagtaaacttcggacccttacgtccgtacggaccccgacccggacccgaaccgtaccggttacccttttaataccgttcgtcgaccgtcgaagtacgaacgtaccagtaacaaacgttaactttaattattacggttataacgttacggtacggggtaccgtaccgggtaaaccctcgtaaccctactcctaccgtccacgtaccctacgacccgaacggccctacgttcccgtcccttacccccggg

SEQ ID NO: 70719 - DNA, 666 bp, Homo sapiens
  misc_feature: GYAE6OF01BN1XV.52.74.G08.1.454.CMB.1.raw
  modified_base (330)..(330): a, c, t, g, unknown or other
  misc_feature (330)..(330): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggcccgataatgaagccctcggagaccctctcactcacctgcaatgtctctggattattcaagttgggagttcggtttattagtgggcctggactccggcgacggcccccgggaagggcgtggagtggagtcggcagcatccatcataggtaggagacaataatcanaactccgtcctacgagacggactagtacctacttttacgagtaggacgtaccgtaccgaacgtaacctacttacctacctagtaactcgtacctcgtctcgaccgtccgaccgaccgtaccgttacctttacgtacgtgtcggtcgtacgtacggtacgaacacgagtacctaaattaacttattacgttagttagtaagttacggttcgggacccggtaccgggtaaccccggtaccgtacccgtaacgttcccgtacctccgtacccgtaccccgtaacccggaaccgaacccgggtaccccgtaaccgttcccgggtccccgtttcccccggg

SEQ ID NO: 70720 - DNA, 590 bp, Homo sapiens
  misc_feature: GYAE6OF01D24CP.52.74.G08.1.454.CMB.1.raw
  modified_base (365)..(365): a, c, t, g, unknown or other
  misc_feature (365)..(365): n is a, c, g, or t
  modified_base (540)..(540): a, c, t, g, unknown or other
  misc_feature (540)..(540): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaacgccctggagaccctctcactcacctgcaatgtctctggactattcaattgggagtggttattagttgggcctggactccggcacggccccccgggaaggggcgtggagtggagtcggcaggcactccatcagtaggtggagacaataatcacaactccgtcctacagagacgactctacctttnagtggacgacgtaccaagaacctactctacctagtaactcgacctctctacgaccgccgcccgactaccggtaccctttactactggtcgcgcgtagtcgaacacagactaagttaacttattatagttataagtacgttcgggaccgtaacgggaccccgtacgacgcttaccncctccacgtcccaccaccgaacggacctaccggtccgttccctcccccgg

SEQ ID NO: 70721 - DNA, 634 bp, Homo sapiens
  misc_feature: GYAE6OF01BGDYL.52.74.G08.1.454.CMB.1.raw
  modified_base (196)..(196): a, c, t, g, unknown or other
  misc_feature (196)..(196): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccaggaggggtcctgtcccaggtgcagctccaggagtcgggccccggataatgaagccctcggagaccctntcactcacctgcaatgtctctggatattcaagttgggagttggttattagttgggccttggactccggcacggcccccggggaagggcgtggagtggagtcggcagcatccatcgagtaggtggagacaagtatacacaactccgtcctacgagacggacgtagtctactttcgagtggacgtacgtacgaacgaacctacttctcctagtaactgacctctacgtcgacccgccgccgacgaccggttcctttattacgtgtcggcgacgtagtacgaacacgagtactaattaacttagttaagttgttagtaacggttacggttacgggaccggaaccgggtaaccccggtcctaccgtacgtccttacctacgacccgtccctaacccgacccggaaccggtaccctaccgttcccggttccccgttcccccgg

SEQ ID NO: 70722 - DNA, 735 bp, Homo sapiens
  misc_feature: GYAE6OF01AWO6G.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccaggagggtcctgtcccaggtgcagctccaggagtcgggccccgactaatgaacgccctcggacgaccctctcactcacctgcaatgtctctggatattcaagttgggagttggttattagttgggacctggactccggcaccggcccccggggaagggctggagtggagtacggcaggcagtcccatactagtaggtggaagaactaaagtactacaacgtaacgtacccgtaccctgaacgaggaccgtagttccgtacttttagaggttacggacgtacgtacaacgtaaacctaacgtttcctaccctagtaaacttcgacccttctaccgtacgtaccccggccgtaccccgaccgtacccggttaccctttacgttacggtcgtcggacccggtacgtagggttacaaccgtacgaacgtacctaaattaaccctttaagtttagttacgttaagtaacgtttacgggtccgggaacccgggtacccgggttaacccgtacccgtaaccgtaccgttccccttacctaccgacccgtaccccgtacccgaaccggtaacccgggcccctaaccggtttccccggttaccccgttccccccggg

SEQ ID NO: 70723 - DNA, 703 bp, Homo sapiens
  misc_feature: GYAE6OF01AZ42Q.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaacgccctcggacgaccctctcactcacctgcaatgtctctggatattcaagttgggagttggttattagttgggcctggactccggcaccggcccccgggaaggggtcgtaggagtggagtcggcagccactccgatcgagtaggtaggagaacaagtaactacaacaactcccgtaccctagaacgacggacgagtcctaccgtttcgagtaggacgacgtaccaaacgaacctaacttcctacccgtagtaacttcgaacccttcttaccgtaccggaccccgcccggaccccgaaccggtacccggtacccttttaacgtaccttcggtacggcccgtacggtaacgtacgaaaccgtaccgaacgtactaaactttaaactttaacgtttaagttacggttaagttaagtacggttacgggacccgtaaccgggacccccgtaaccaccgtacctcctacccgtcgacctccctaccgaacccgtacggacccctacgttcccggttaccccgtccccgg

SEQ ID NO: 70724 - DNA, 688 bp, Homo sapiens
  misc_feature: GYAE6OF01A323X.52.74.G08.1.454.CMB.1.raw
  modified_base (381)..(381): a, c, t, g, unknown or other
  misc_feature (381)..(381): n is a, c, g, or t
  modified_base (618)..(618): a, c, t, g, unknown or other
  misc_feature (618)..(618): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggacggtccggggccccggactaatcgaagccctcggacaccctctcactcacctgactaatcgtctcgtggattattacgaagttgggagttaggttatttagttcgggccgtaggacgtcccggccgaccgggaccccccgggggaaggggtccgtagggtacggtggacgtcggacacggcctataccgtatactagtacggtaggaagaactaaagtaacncaacgtaacctcccgtccctacgaacggacggtacgacgttcgtacctttacgaggtaggacgtaccgtaacaacggaacctaacgttccctaccgtagtaacgttcctaccttacgtcgtaccgaccgtcccgaccgaccgtccgtacctttataccgtgtcgccgtacgatacgacagcgtaactaattaacttattagtagtacgtaagtacgtacgggaccgtacggtacccncgtaaccgttaccccgctacaccgacccgacgaaccgtaccggacccttacgtccgttcccgttacccgg

SEQ ID NO: 70725 - DNA, 649 bp, Homo sapiens
  misc_feature: GYAE6OF01A52A3.52.74.G08.1.454.CMB.1.raw
tcagcgcagtacgacacgaccggtgctcgatttagtagctctatctaggggggctttctgagagtcatggacctcccgcgcaagaacatgaagcacctgtggtttttcctcctgctggtgacagctcccagaggggtcctggtcccaggtgcagtctccaggagtcgggcccggataatgaagccctggagaccctctcactcacctggcaatgtctctggatattcaattgggatggttattattgggcctggactccggcacgcccccgggaagggctggagtggatcggcagcatccatcatagtggagacgaataatcacgaactcccgtcccgtacgaggacggacgtacgtcctaccttttcagtggacgacgtaccaagaacctaattcctccctagtaacttcgacctctcctcgacccgccgccgacaccggtccctttatacctgtcgcgacgagtgaacacacgactaaacttaacttaattacgttagttagtaacttacggttacggggacccgtaaccggggtaccccccggtacgtaacccgtacttacccgttaccctaccgaccgttccccttacccgaacccggtaaccgggtaccccctacgttccccgggttccctttacccccccggg

SEQ ID NO: 70726 - DNA, 751 bp, Homo sapiens
  misc_feature: GYAE6OF01BJLY6.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccaggacggggtcctcgtcccaggtcgcagctccgaggacggtccggggccccgataatgaacgcccgtcggacgaccctctcactcacctgactaatgtctcgtgattatacgaagttggagttgttattagtcggctggtacgtccggacgaccggaccccggggagggcgtagggaggtggacgtccggagtacgactactccgatcgaagtacggtaggaactaacgtaataactaccgaactaaccgtcctaccgtacgacggacggtacgtacgtactaccgtttacgacggtagaacggtaccgtaaccgaaacgtaaaccgttacttccgtaacctagtaacttacgtacctcgtaccgtacgacccgtaccgcccgtaaccgttacggtacctttagtccgtaggtcgcgtacgacgtacgaacacgtactaactaacgttaacgtttagttacgttagtaagtacgttacgggttcccgggaaccgggtaacccgggtacccgaaccgttaccgttacccgtcccttaacccgtcccgaaccctaccccggtaaccccgtaacccggtacccggtaacccccttccgtaccccgggtttcccccgtaacccccggg

SEQ ID NO: 70727 - DNA, 886 bp, Homo sapiens
  misc_feature: GYAE6OF01B24S8.52.74.G08.1.454.CMB.1.raw
  modified_base (107)..(107): a, c, t, g, unknown or other
  misc_feature (107)..(107): n is a, c, g, or t
tcagcgcagtacgacacgaccggtgctcgatttagtagctctatcagggggctttctgagagtcatggacctcccgcgcaagaacatgaagcacctgtgtttttccnctgctggtgacagcctcccaggacggggtcctgtcccgaggtgcagcctccgaggacggtccgggccccgaattaatggaacgccctcgggacaccccttctcacctcaccctgacctaattgtacctgtaggtattacttacgtaaagttggggagtttaggtttaactttagtcggggtccttggaacgttcccggaccggtacccgggacccccggggaaggggtcgtagggaggtagggacgtaccgggctacggcctaacgtcccaagtacgtaagttaggaggtaacgaaactaaagtaactacgaactaacgttccccgtaccgtacgaacgggaacggtaaccggtacgttaccttaaccgttttacgaacggtacggtaaccgtaaccgtaaccgaaacgtaaaacctacctttaccgtacccgtaagttaacgttcctaacccgtcttaaccgtccggacccgaccccgtacggacccgtaccgtttaccctttaagttccgttacgtccggaccgtacggtaaccgtaacgaaccctacgtaaccgtaataaacccgtttaaagtttacgtttatttaacggtaaaggttaacgtttaaccgggttacggggtaaccccgggttaaacccgggtaacccgttaacccgtaccgttaaccgttaccttaccccgtacccgttaaccgacccccgttaaacccggtaacccggtaacccccgggtactttacccccgggttacccgggtttcccccccgttaaccccggg

SEQ ID NO: 70728 - DNA, 1096 bp, Homo sapiens
  misc_feature: GYAE6OF01AVUQM.52.74.G08.1.454.CMB.1.raw
tcagcgcagtacgacacgaccggtgctcgatttagtagctctatcagggggctttctgagagtcatggacctcccgcgcaagaaccatgaagcacctgttggtttttcctcctgctggtgacagctcccaggaggggtcctgtcccaggtgcagctccgaggacggtccgggccccggataatcgaacgcccgtcggagaccctctcactccaccgtgacaatcgttcctcgtaggtattaatttaccgtaagtttggggaagtttgggttttaatttacggtttcggggcccttaggggtaacctccccgggaccgtaacccgggacccccccggggggtaaagggggtccgttggggtaacggtacgggacgttccggggaccgacggactacgttacccagtaccgtaagttacggttagggaacgaaccgtaaattaactacccgtaaaccgtaaacccttccccggttaccccgttacggaacgggtaaccgggtaccggtaacccggttttaccctaaccccgtttttcgaacgggttacggggtaacccgttaacccggttaaacccgtaaaaccgggtaaaaacccccttaaacggtttttaccccccgttaaccccggtttaaaacggttaaaaccgttttacccggtaacccccgtttacctttaacccccgggtaccgggtacccccccgggttaaccccccgggtacccgttaaaacccccggttacccgggttacccctttttttaaaccggttacccgggttcgtaaaccggggtcccgttaacgggtaaaccgttaacgggaaacccctaaccgggtaaccttaaaccgttaaaccggtttaaacccgttttaagttttaaggtttaccggggtttaaacttaagggtttaaccggggttacccggaaaccccggggttaacccggggttaaacccccccgggtaacgtaaacccgttccccgtacccggtttaacccctacccggttaccccgttaccccgtaaccccccggaaacgggtacccccggttacccttaccttaacccccccgggggttttccctttaaccccccccggggg

SEQ ID NO: 70729 - DNA, 790 bp, Homo sapiens
  misc_feature: GYAE6OF01AS46T.52.74.G08.1.454.CMB.1.raw
  modified_base (328)..(328): a, c, t, g, unknown or other
  misc_feature (328)..(328): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaacgccctcggagaccctctcactcacctgcaatgtctctggattattcaagttgggggtgttattagttcgggcctggactccggtcgaccggcccccggggaaggggcgtgggagtggagtcggcagcatccatcaagtagtaggaanacgaaataactcaacctaactcccgtaccctacgaggtaacggaccgtacgtaccgttacccttttacgaaggtacggaacggtaccggtacccaaacggtaaaccctaacgtttacctacccttagtaaaacgtttccggtacccttccgtacgtaccggaccccggtcccgaacccgtacccgtaacccggttcccttttaacgttaccgtcggtacggtaccgtacggtaacgtaaccgtaacgaactaacgtaaccgttaaacttaactttaacgtttagttagttaacggttaacgttacgggttaccggggacccgtaacccgggggtaaccccgtaccgtaaccccgtaacgttcccgttaccctacggtacccgtaccccctacccggtaaccccggtaacccgggtacccctaccggttacccccggtttcccgtttcccccccggtcccggg

SEQ ID NO: 70730 - DNA, 768 bp, Homo sapiens
  misc_feature: GYAE6OF01BMHM1.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacaggctcccgaggacggggtcctgtcccgaggtgcagctccgaggacggtccgggccccggataagtgaacgcccgtcggacgaccctctcactccacctgacaatcgtctcgtaggtattatacgtaagttgggtaagttggtttaactttaggttcgggtccgttaggaccgttcccggaccgacccgggaccccccggggaaggggtccgtagggtagggtcggacgtcgggacaacgcgtaccgtccagtacgtaagttaggacgaacgaactaagtaactacaacgtaacctcccgtacctacgacggacggtaccgtaacgttcctaacgtttagaggtaggacgtaacgtaccgaaacgtaactacgtttccgtacctaagtaacttacgtacctcgttaccaccggacccgccgaccgtaccgtaccgttaccctttagtaccgtcggtacgtaccgtacgacggtaactacgaacgtacggtaacttaaatttaaccgttagttaacgttagttaacgtaacgttggtaccgggaccgtaaccgggtaaccccgtacaaccgtaccgtacctacccgcgtaaccgtccccgaccgtaaccggtaccctaccgtcccgttaccccggtcccgttcccccgg

SEQ ID NO: 70731 - DNA, 670 bp, Homo sapiens
  misc_feature: GYAE6OF02JWW7N.52.74.G08.1.454.CMB.1.raw
  modified_base (360)..(360): a, c, t, g, unknown or other
  misc_feature (360)..(360): n is a, c, g, or t
  modified_base (417)..(417): a, c, t, g, unknown or other
  misc_feature (417)..(417): n is a, c, g, or t
  modified_base (571)..(571): a, c, t, g, unknown or other
  misc_feature (571)..(571): n is a, c, g, or t
tcagcgcagtacgacacgaccggtgctcgatttagtagctctatcaggggcgtttcttgagagtcatggacctcccgcgccaagaacatgaagcacctgtggttttccttccttgctggtgacagctcccagaggggtcctgtcccaggtgcagctccaggagtcgggccccggactaatgaagccctcggagaccctctcactcacctgcaatgtctctggatattcaattgggatggttattattgggcctggatctggcagcccccggaaggggctggagtggatcggcagcatccgatcatagtggagacaataatcacaatccgtccctacagacggacgagtcctaaccttttnaagtgggaacgacgtccaaaagaacccaagttccaccgtagaaatttgaaccttctntcgaccgaccgccgacacggtcccctttaattacctgttcgtacgcgtaacgttggaaacctacgaacggacaaacgttaaacctttaaattagttacgtttagggaaaactttggttaccgggggaccctaacgggggaaccccccggtttanaaacccgtagtttacccttacccccggtataacccggggtccccttaccccgaaacccggtaaaggggtcccccccctaggttaccccgggtttccccc

SEQ ID NO: 70732 - DNA, 548 bp, Homo sapiens
  misc_feature: GYAE6OF02FKBJ3.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagccccccgggaaggggctggagtggatcggcagcatccatcatagtggagacaataatcacaatccgtccctcagaggacgagtcaccttttcagtggagacgtcaagaaccaattctccctgaaattgacctctctgacccgccgccgacaccggccctttatactgtgcgcgagtgaacacagcaataacttattatgttagaattagttcggggaccaagggaccccggtcaccgtatctccctcacgcctccaccgaacgggccccagtccggtcttcccccg

SEQ ID NO: 70733 - DNA, 639 bp, Homo sapiens
  misc_feature: GYAE6OF02I10O2.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcacgcccccgggaaggggctggagtggatcggcagcatccatcatagtggagacaataatcaacaactccgtcctacgaggaggacgagtcctaccttttcgaggtaggacgacgtaccaagaacctaattcctaccctagtaacttcgaccttctctacgacccgccgaccgactaccggtaccctttattacgtgttcgcgcgagtacgaacacacgactaaattaactttattagttgttataagttacgttacggggaccgtaaccggggtaccccgtacaacccgtactcccgttacctaccgaacgtccccttaacccgaacccggtaaccgggtaccccctaacggttacccggttcccctttaccccccggg

SEQ ID NO: 70734 - DNA, 589 bp, Homo sapiens
  misc_feature: GYAE6OF02GYK87.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcacgcccccgggaaggggctggagtggatcggcagcatccatcatagtggagacaataatcaacaatccgtccctcagaggacgagtctaccttttcagtggacgacgtaccaagaacctaattctaccctagtaaacttcgacctctctcgaccgccgccgacacggtccctttattacctgtcgcgcgagtacaacacagacctaaattaaccttattattgtttagaagttagttcggggacctacggggtaccccgtacgacccgtaatccttccctacacgccctacccgaccgaacgggccccacgttcccggtccttccccgg

SEQ ID NO: 70735 - DNA, 553 bp, Homo sapiens
  misc_feature: GYAE6OF02H2RPH.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggcccccggactaatgaagccctcggagaccctctcactcacctgcaatgtctctggatattcaattgggagtggttattattgggcctggatccggcagcccccgagaaggggctggagtggatcggcagcatccatcatagtggagacaataatcacaatccgtcctcagaggacgagtcactttcagtggagacgtcaagaaccaattctccctagtaaattgaccctctctcgaccgccgccgacacggtccctttattactgtgcgcgagtgaacacagacaataacttattactgttagaattagttggggaccaggggtacccccgtgaaccctatcctcctcacgtccctaccaccgaacgggtccctagttccggtacccc

SEQ ID NO: 70736 - DNA, 583 bp, Homo sapiens
  misc_feature: GYAE6OF02FQBAH.52.74.G08.1.454.CMB.1.raw
  modified_base (353)..(353): a, c, t, g, unknown or other
  misc_feature (353)..(353): n is a, c, g, or t
  modified_base (474)..(474): a, c, t, g, unknown or other
  misc_feature (474)..(474): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcagcccccggaaggggctggagtggatcggcagcatccatcatagtggagacaataatcacaatccgtccctcagaggacgagtctaccttttnagtggagacgtccaagaaccaattctccctagaattgacccttctctcgaccgcccgccgaccacggtccctttatactgtcgcgacgtagtgaacacagacaataacttacttatgttanaagttagttcgggggaccaacggggtaccccggtcaacccgtactacctccctacaccgaccctcccaaccgtaaacgggcccctaagttcccggtacccttccccccg

SEQ ID NO: 70737 - DNA, 558 bp, Homo sapiens
  misc_feature: GYAE6OF02I0H4A.52.74.G08.1.454.CMB.1.raw
  modified_base (374)..(374): a, c, t, g, unknown or other
  misc_feature (374)..(374): n is a, c, g, or t
  modified_base (460)..(460): a, c, t, g, unknown or other
  misc_feature (460)..(460): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccaggaggggtcctgtcccaggtgcagctccaggagtccggggccccggactaatgaagcccctcgggagacccctctcactcacctgcaatgtctctggatattcaattggggagttggttattagttgggcctggatccggcagcccccgggaagggctggagtggatcggcagcatccaatcgatagtggagacgaataatcaactaactccgtccctacagaggacgagtctactttcagtgganacgtacaagaaccaattcctcctagaaacttgacctctctcgacccgcgccgacacggtcctttatactgtgcgcgtagtgaacanacgactaactaactattatgttagaatagttgggcacggaccgtcacctactactcctcacgcctaccaccgacggccctactccgggtcctccccgg

SEQ ID NO: 70738 - DNA, 628 bp, Homo sapiens
  misc_feature: GYAE6OF02G3FGT.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattagttgggcctggatccggcacggcccccgggaaggggctggagtggatcggcagcatccatcatagtggagacaataatcacaactccgtccctcagacggacgagtcaccttttcagtggacgacgtacaagaacctaattcctcccgtagtaaacttcgaccttctactcgaaccggtcccgaccgaaccgtaccggtacccttttagtacctcggttcggtcgtcggtagtacgaaaccacgacgtactaaacttaactttaattagtacgtttagaagtttacggttacgggggaccgaccggggtaaccccggtcaacccgtacttcctcctaccacgccctaccgaccgaaccggccctacgtccggtacccttccccgg

SEQ ID NO: 70739 - DNA, 595 bp, Homo sapiens
  misc_feature: GYAE6OF02HQB8L.52.74.G08.1.454.CMB.1.raw
  modified_base (336)..(336): a, c, t, g, unknown or other
  misc_feature (336)..(336): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggataatgaagccctcggagaccctctcactcacctgcaatgtctctggatattcaattgggagttggttattattgggcctggatccggcacggcccccgggaaggggctggagtggatcggcagcatccatcatagtggagacaataatcaacaatccgtccctnagaggacgagtcaccttttcagtggagacgtccaagaacctaattctccctagaaacttcgaccttctactcgaccgccgccgacacggtccctttatactgtcgcgacgtagtagaacacagacaaattaacttattagttgttagtaattagttcggggacctacggggtaccccggtcaacccgtatcccttaccgtcaccgtaccctaccgaacccgaaccgggcccctaacgttccgggtacccttacccccgg

SEQ ID NO: 70740 - DNA, 647 bp, Homo sapiens
  misc_feature: GYAE6OF02IZ7JK.52.74.G08.1.454.CMB.1.raw
  modified_base (325)..(325): a, c, t, g, unknown or other
  misc_feature (325)..(325): n is a, c, g, or t
tcagcgcagtacgacacgaccggtgctcgatttagtagctctatcaggggggctttctgagagtcatggacctcccgcgcaaggaacactgaagcactgtggtttttcctcctgctggtgacagctcccagaggggtcctgtcccaggtgctagctccaggagtcgggccccggactaatgaagccctggagaccctcgtcactcacctgcaatgtctctggatattcgaattgggagtggttattagttgggcctggatccggcaggcccccgggagggctggagtggatcggcagcatccatcatgtggagacgaataatcanaactccgtccctgagaggacgagtctaccttttcgagtgacgacgtaccaagtaaccaacgttcctaccctagtaaacttcgacccgttctcgtacgacccgccgacccgacgaccggtccttttaacgttactggttcgcgtacgtagttacgaacctacgaagactaaattaactttagttaacgttgttacgtaaattacggttacgggaccgtaaccgggtaccccgtacgtaaccgtacttccgtaccgtacgaccgtccctaaccgacccggtaaccgggcccctaacggttcccggttacccctttaccccccgg

SEQ ID NO: 70741 - DNA, 662 bp, Homo sapiens
  misc_feature: GYAE6OF02IL238.52.74.G08.1.454.CMB.1.raw
tcagcgcagtacgacacgaccggtgctcgatttagtagctctatcagggggctttctgagagtcatggacctcccgcgcaagaacatgaagcacctgtggttttttcctcctgctggtgacagctcccagaggggtcctgtcccaggtgcagctccaggagtcgggccccggactaatgaagccctcggagaccctctcactcacctgcaatgtctctgatatcaattgggagtggttattagttgggcctggatccggcacggcccccgggaggggctggagtggatcggcagcagtccatcataggtggagacaataatcaacaactccgtcctacgagacggacgagtcctaccttttacgagttggacgtacgtaccaaagaacctaattcctacctagtaacttcgacctctcgacgacccgccgacccgacgtaccgtaccctttaattaccgtgttcggccgtacgtacgtacgaaccacgacgactaaacttaactttaagtttaattacggttaagtaacgtttacggttcgggggtacccgaaccggggtaaccccggttaccaacccgtacttaccctcccttaacgacccgtaccctacccgacccggaaaccgggcccctacggttccccggtcccgtttaccccccgg

SEQ ID NO: 70742 - DNA, 645 bp, Homo sapiens
  misc_feature: GYAE6OF02JWU1J.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatcgtctctggatattcaagttggggagttggttattagttgggcctggatccggcacggcccccggggaaggggtcgtggaggtggagtcgggcaggcatccatcataggtggagacaaagtaatacacaactcccgtcctcacggaggacgagtcaccttttcaggtggagacgtacctaagaactaacttctaccctagtaacttcgacctctctagacccgccgtaccgacctaccgggtacccttttactacttcggtacgtcggacgtacgtacgaaccacgtagacctaaattaaccttagttactgtttacgaattacggtacgggtaccgacgggtaccccgtgtaaccctacgttacctcctacgtaccgtccctaccgtaacccggaccgggtccctaaccggttccccggtacctttcccccgg

SEQ ID NO: 70743 - DNA, 631 bp, Homo sapiens
  misc_feature: GYAE6OF02I7724.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagagggtcctgtcccaggtgcagctccaggagtcgggccccggataatgaagccctcggagaccctctcactcacctgcaatgtctctggatatcaattggagtggttattagttgggcctggatccggctacggcccccgggaagggctggagtggagtcggcagcactccatcataggtggaagaccaagtaatcaactaactcccgtcctacgaagacggacgacgttcctaccttttcgaggtcggtacgaccgtacgtaaacgaaacctaacgttcctacccgtagtaaacttcgacctctactacgtacccgccgaccgacgtaccggtcctttacgtactgtcgacgcgtagtacacacagactaattaacttattagtagttacgtaattacggtacgggaccgtaaccggtacccgtacaaccgtatacccttacgtaccgtacgtcccgtacccgtacgaaccgggtccctacggttaccgtcccttaccccgg

SEQ ID NO: 70744 - DNA, 753 bp, Homo sapiens
  misc_feature: GYAE6OF02ICM3I.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagttgttattagttgggcctggatccggcaccggcccccgggaaggggcgtggagtggagtcggcagcatccatcatagtggaagacaataatcaacaactcccgtacctcaggaacggacgaacgtccttaccttttacgaggttacggaacgtaccgtaccgaaagtaaccctaacttcccttacccgtagttaaactttccgaccttccgttaccgtccggaccccggcccgacccgtaaccggtaaccgggttaccccctttttaagttaaccgttggtaccggtccggtaccggtaagttcgaaaaccacgtaaacggtaccttaaaacgttaacctttaatttacgttaggtttaataaagtttaacgggttacgggggacccgtaaaccggggttaaccccccggtactaacccggtaacttccccgttaccgacccttaccggacccccttaccggaacccggtaaccgggtaccccctaacggtttccccggtacccctttaccccccgggg

SEQ ID NO: 70745 - DNA, 596 bp, Homo sapiens
  misc_feature: GYAE6OF02HUHWG.52.74.G08.1.454.CMB.1.raw
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
tcagcgcagtacgacacgaccggtgctcgatttagtagctctatcagggggctttctgagagtcatggacctcccgcgcaagaacatgaagcaccttgtggtttttcctcctgctggtggacagctcccagaggggtcctgtcccaggtgcagctccaggagtccgggccccggactaatgaagccctcggagaccctctcactcacctgcaatgtctctggatacttcaattgggagtggttattattgggcctggatccgcagcccccgggaagggctggagtggatcggnagcatccatcatagnggagacaataactcacaactccgtcctacagagacgatcctacttttcagtggaacgacgtaccaagaacctaattcctaccctagaaacttcgacctctcgtcgaccgtccgccgacacggccctttaatacgtagtcgcgacgtagtacgaacacgacgacgtaaagttaacttattacgtaggttacgtaagttagtcggggacacggggtaccccgtcaaccctagttcctacctccgacgcctaccaccgaaccggcccctagtcccggtacccttcccccgg

SEQ ID NO: 70746 - DNA, 659 bp, Homo sapiens
  misc_feature: GYAE6OF02FIW3S.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtccgggcccccggactaatgaacgccctcggagaccctctcactcacctgcaatgtctctggatattcaattgggagtggttattagttgggcctggactccggcacggcccccgggagggctggagtggatcggcagcatccatcatagtggagacaataatcactaactccgtcctacagaggacgacgtctaccttttcgagtggacgacgtccaaacgaacctaactttcctaccctagtaaacttcgaccttctactcgacccgtcccgaccgtaaccgaccggttaccctttagttaccgttcgtcggaccgtacgaacggtacaaaccgacgacgaacctaaattaactttaatttagtagtttacgtaagttacggttacggggacccgtaaccgggtaaccccgtacaacccgtacttccgtaccctacgaccgtccctacccgaacccggaaccgggtcccctacggttccccgtcccttaccccccgg

SEQ ID NO: 70747 - DNA, 709 bp, Homo sapiens
  misc_feature: GYAE6OF02H7I5G.52.74.G08.1.454.CMB.1.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
tcagcgcagtacgacacgaccggtgctcgatttagtagctctatcagggggctttcgtgagagtcatggacctcccgcgcaagaacatgaagcacctgtggtttttcctcctgctggtgacagctcccagaggggtcctgtcccaggtgcagctccaggagtcgggccccggactaatgaacgccctcggagacccctctcactccacctgcaatgtcnctggatattcaattggatgtattntgggctggatccgcacgccccggaagggctggagtggatcggcagcgaactccaatcatacggtgagacaataatcacaatccgtacctcagtaggacgagtcgaccttttcagttaggagtacgtaccaacgaaaccaagttcctaccccgtagaaactttcggaacccttctaccttacggaccccggaccgacccggaaaccgtacgggtacccctttttaaagttaccttaacggttcggtaccgacggttacggttacgaaacacccgtaagtaccggaaaactttaaaccgttaactttaacgttacgtttagtaaacgttaaggttaccgggggtacccgaaaccggggtaaccccgggtacctaacccgtagttacccgttcccgtaaccgtaaccgtcccgttaccccaaccggtaaaccgggtcccctaacttcccgggtaccctttaccccccgg

SEQ ID NO: 70748 - DNA, 937 bp, Homo sapiens
  misc_feature: GYAE6OF02GOYDB.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggcccggataatgaagccctcgggacctacctcactacacctacgtcactagtctctgtagtattactagtaggtggtaggttagttagttaggtcggtcggtagtccggtcgacggacccccggggacccgggggacggtcggtaggtacgggtaggtacggtccggacgacgactacctacgtactacgtaaggtagggtaaggaacgaaacgttaaataccgtaaccaaacgttacccgttacccccgttaccgtaacggaacgggaacggtaaccggttaccgttaaccgttttaccgtttacggttacggggtaacggtaacccgggttaaccgaaaccgtaaacccgtaaaactttacccgttaccccgttaaacgttaaacgtttaaaccgttacccgttaccctttaccgttacggggaaacccccgacccccgggtaccccggaaccctaaacccggggtttaccccgtttaaccctttttaaggttaccggttcgggaaccgaccgggttaacgttaacggaaacctaaaccgaggtactaaaaccgtttaaaacttttacttttagttaacggttaggttaaactaaagggttttcggggaacccggaacccggggttaaaaccccggggttccccaactaacccgtttactttccccggtaccctaaaaccgggtccccgttaacccttaaacccccgggaacggggtaacccctaccccggttttacggttcccccccggtttaaccccgtcccccggggg

SEQ ID NO: 70749 - DNA, 568 bp, Homo sapiens
  misc_feature: GYAE6OF02G2GV1.52.74.G08.1.454.CMB.1.raw
  modified_base (195)..(195): a, c, t, g, unknown or other
  misc_feature (195)..(195): n is a, c, g, or t
  modified_base (508)..(508): a, c, t, g, unknown or other
  misc_feature (508)..(508): n is a, c, g, or t
tcagcgcagtacgacacgaccggtgctcgatttagtagctctatcagggggctttctgagagtcatggacctcccgcgcaagaacatgaagcacctgtggttttcctcctgctggtgacagctcccagaggggtcctgtcccaggtgcagctccaggagtcgggccccggactaatgaagccctcggagaccctntcactcacctgcaatgtctctggatattcaattgggatggtattattgggcctggatccggcagcccccggaagggctggagtggatcggcaggcatccatcatagtggagacaataatcgacaatccgtacctcagaggacgagtcaccttttcagtcggagacgtccaaagaaccaattctaccctagtaaacttgacctctcgtcgacccgccgtcccgactaccggtccctttaataccgtggtcgcgcgagtcgaacacagacaaattacttatatgttagaattagttgggacctaggggacccgtnacccgatcctacctcgacgcctaccaccgaacggtcccacgttccggtccttacccccgg

SEQ ID NO: 70750 - DNA, 597 bp, Homo sapiens
  misc_feature: GYAE6OF02FJ9SW.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcggggcccccggactaatgaagccctcggagaccctctcactcacctgcaatgtctctggatattcaattgggagtggttattattgggcctggatccggcagcccccggaaggggctggagtggatcggcagcatccatcatagtggagacaataatcacaatccgtcctcagaggacgagtacacctttacgagtggagaccgtacgaaacgaacctaattacctaccctagtaaacttcgacccttctctacgacccggcccgacccgacgaccgtccctttaataccgtgtcgcgtcggatcggaacacagactaagttacttaattagtagttagaaagttgttacggggacctaaccggggacccgtcgacctactcctacctccacgccctaccaccggaacggtacccacgtccggtccttcccccgg

SEQ ID NO: 70751 - DNA, 681 bp, Homo sapiens
  misc_feature: GYAE6OF02IL5VQ.52.74.G08.1.454.CMB.1.raw
  modified_base (195)..(195): a, c, t, g, unknown or other
  misc_feature (195)..(195): n is a, c, g, or t
  modified_base (328)..(328): a, c, t, g, unknown or other
  misc_feature (328)..(328): n is a, c, g, or t
  modified_base (499)..(499): a, c, t, g, unknown or other
  misc_feature (499)..(499): n is a, c, g, or t
  modified_base (509)..(509): a, c, t, g, unknown or other
  misc_feature (509)..(509): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctggagaccctntcactcacctgcaatgtctctggattattcaagttgggagttggttattattgggccttggactccggcacgcccccggggaagggctggagtggatcggcagcagtccatcatagtggagacaataatcaanaacgtccgtacctcagagacgacgtcaacttttcgagtggacgtacgtacaaacgaacctacttcctacccgtagtaaacgtcgtacctcgtactcgaccccggaccgtacccggaacgtacccgggttacccttttaacgttaccgttggttcgaccgtacgtacggtanaaaccgtaanacggactaaatttaacgttaactttagttagttaacgtaagtttacggtagggtacccggtaacgggtaacccccggtacaacccgttattacccctaccgtaccgaccgtcccgttaacccgaccggtaacccgggtacccaacggtttaccccgtcccgtttacccccgg

SEQ ID NO: 70752 - DNA, 662 bp, Homo sapiens
  misc_feature: GYAE6OF02FM2ZB.52.74.G08.1.454.CMB.1.raw
  modified_base (361)..(361): a, c, t, g, unknown or other
  misc_feature (361)..(361): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggcccccggactaaatgaagccctcgggagaccctctcactcacctgcaatgtctctggatattcaattgggagtggttattattgggcctggatccggcacgcccccgggaaggggctggagtggatcggcagcatccgatcatagtggagaacaataatacaacaactccgtcctcagaggacgagtctacctttnagtggacgacgtacaaagaacctaattcctacctagaaacttcgtacccttctcgtacgacccgcccgtacccgaccgaccggttacccctttaattaccgtggtcgacgtacgagtacgaaccacgacgactaaacttaactttaattaacgttagttagtaagttacggtacgggaccgtaccggggttaacccccgtcaacccgttactacccttacccgtacgtaaccgtccccttaacccgaacccggtaaaccgggtacccctaaccggttccccggttccctttaccccccggg

SEQ ID NO: 70753 - DNA, 610 bp, Homo sapiens
  misc_feature: GYAE6OF02G91VS.52.74.G08.1.454.CMB.1.raw
  modified_base (550)..(550): a, c, t, g, unknown or other
  misc_feature (550)..(550): n is a, c, g, or t
  modified_base (557)..(557): a, c, t, g, unknown or other
  misc_feature (557)..(557): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagttggttattagttgggcctggactccggcacggcccccggggaagggcgtggagtggagtcggcagcactccatcagtagtggagacaataatcaacaactcccgtcctacaggacggacgagtacctaccttttcaggtcggaagtaccgtaccaaacgtaacctaacttcctacccgtagtaacttcgacccttctctacgacccggtcccgacccgactacccggtcccttttaataccgttgtcgacgtcgagtacgaacacagactaataactttatatgttagaattagtcgggacaccgggtacccgtnaaccgtntcctcctactacgaccctaccgaccgacggtcccacgttccgtccctccccgg

SEQ ID NO: 70754 - DNA, 642 bp, Homo sapiens
  misc_feature: GYAE6OF02F0DDC.52.74.G08.1.454.CMB.1.raw
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggcccccggactaatgaagccctcggagaccctctcactcacctgcaatgtctctggatattcaattgggatggttattagttgggcctggactccggcacggcccccggggaagggctggagtggatcggcagcactccatcagtagtggaanaacaataancacatcccgtcctcaggacgacgacgtctacctttcgagtggacgacgtaccaaagaaccctaattccctaccgtagtaacttcgaccttctctacgacccgccggacccgaaccgtaccgttaccctttataccgttcgtcggtcgcgacgttacgaactaacgacgtacctaaattacctttaatttagtgtttaacgaatttaggtcgggacccgaaccgggtacccgtacacccgtacgttacccttcccgtctaccgcccgtacccgaacccggaccgggcccctacggttcccgttaccccgttccccgg

SEQ ID NO: 70755 - DNA, 755 bp, Homo sapiens
  misc_feature: GYAE6OF02I9P6P.52.74.G08.1.454.CMB.1.raw
tcagcgcagtacgacacgaccggtgctcgatttagtagctctatcagggggcgtttctgagagtcatggacctcccgcgcaagaacatgaagcacctgtggtttttcctcctgctggtgacagctcccagagggtcctgtcccaggtgcagctccaggagtccgggccccggactaagtgaagccctcggacgaccctctcactcacctgacaatgtctctggatattcaagttcgggagttggttattagttgggccttggactccggctacggcccccggggaaggggctggagtggacgtcggcaggaccacgtccagtcagtaggtaggaggaacaaataacgacaacactcccgtccctacgaggacggacgacgtcctaccgttttcgacggtaggacgtaccgtacaaacggtaaccctaacttccgtacccttagaaacgtttccgaacccttactaccgtacgaccccggtacccgaccggtaacccgtaccgggttaccccttttaagttaccgtggtaccggccgtacggtacgtaccgaaacctacggaacgtaacaaactttaaacgtttagttaatacggttactaaacgttagggtttaccggggaacccgtaacccggggtaaccccggttaccaacccgttaacgtaccccgttacctaccgtaacccgtacccgtaacccgtaacccgggaacccggttccctacgggttcccccggttacccgtttaccccccggg

SEQ ID NO: 70756 - DNA, 865 bp, Homo sapiens
  misc_feature: GYAE6OF02HVNS8.52.74.G08.1.454.CMB.1.raw
  modified_base (289)..(289): a, c, t, g, unknown or other
  misc_feature (289)..(289): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccaggacggggtcctcggtcccagggtgcagcctccaggacggtccggggccccggataatgaacgccctcggacaccctctcactcacctgactaagtgtctcgtaggattacttactaagttgggagttaggttacttagttcgggacctggaccgtccggntaaccgggaccccccggggaagggccgtagggaacggtggtagtcggacgacggacaactcctaataccgtaagtacgggtaggaacgtaaaccgaaattaacgtaaccaaacctaaacgtcccgtacctacgaaggacggtaacggtaacgtaccttaccgtttttacgaaggtcggtaacggaaccgttaaaccgaaacggtaaaacccttaaacttacccgttacccgtaaaggttaaacctttaaccgtacccgtttaaccgtaccgttaaccggaaccccgggaccccgtaaacccggtaaccggtacccccggtttacctttaacttaccggttaacggtcgggttaccgacggttaacggtaaacgaaaccgaaccgtagtaaaccgttaaactttaaaccgtttaagttaacgttaacgttaaagtaaacgtttacgggtacgggaaccggttaacccggggacccgttaaccaccgtacttacccttcgtacccgtaaccggtacccctaccgtaaacggtaacccgggaacccttacggttccccggttacccgtttaccccccgg

SEQ ID NO: 70757 - DNA, 711 bp, Homo sapiens
  misc_feature: GYAE6OF02J2IZ6.52.74.G08.1.454.CMB.1.raw
  modified_base (366)..(366): a, c, t, g, unknown or other
  misc_feature (366)..(366): n is a, c, g, or t
  modified_base (487)..(487): a, c, t, g, unknown or other
  misc_feature (487)..(487): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccaggacggggtcctgtcccaggtgcagcctccgagggacgtccggggacccccggataatgaacgcccgtacggacgtacccctctacacctccaccgtgacaattgtctctaggattatcgaagttgggagttggttattagtgggcctgggactccgggcaccggcccccggggaagggtctgggacgtggactcggctacgctactccatccaagttagtggacgaacctaattaanccaaactaaccgtcccgttacccagaaggacgggtaaccgtacgtccttaacccttttcgaaggtggaacgtacgtaccaaagtaaccctaacttctacccgtagtaacttcggcctaccnccgtacacccggcccgacgacccgtacttccgtttacatcggtacgcgacggtacaggaccagctaaattacttaacttagttagttcgttaaggactttacgggcggggtaacccgaccggggtaaccctccggaaccttcgtaccccgtctaccgggtacccctcccttaacccgacccggaaccgttccccaaccgggtttcccggttcccctacccccgg

SEQ ID NO: 70758 - DNA, 550 bp, Homo sapiens
  misc_feature: GYAE6OF02GPW1P.52.74.G08.1.454.CMB.1.raw
  modified_base (411)..(411): a, c, t, g, unknown or other
  misc_feature (411)..(411): n is a, c, g, or t
  modified_base (481)..(481): a, c, t, g, unknown or other
  misc_feature (481)..(481): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
  modified_base (548)..(550): a, c, t, g, unknown or other
  misc_feature (548)..(550): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggcccccggataatgaacgccctcggacgaccctctcactccacctgcaatgtctcgtggatattacaagttggggagttggttaattagttggggccttggactccggcaccgggcccccgggaaggggctgggacggtggagtcggacgagctaactccgaatcaagtaggtaggaacgaactaaataaactactaacgtaactcccgtaccctacgaacggaggaacgactacctaccgttttanacggtggaacgtaactaccgaaacgtaactaacttcctaccgtagtaaacttcgtacctctctacgaccnccgaccgacacgtaccttactactgtcgacgngtagacgacacanactaatatattatgttataagnnn

SEQ ID NO: 70759 - DNA, 880 bp, Homo sapiens
  misc_feature: GYAE6OF02I9GCN.52.74.G08.1.454.CMB.1.raw
  modified_base (152)..(152): a, c, t, g, unknown or other
  misc_feature (152)..(152): n is a, c, g, or t
tcagcgcagtacgacacgaccggtgctcgatttagtagctctatcagggggctttctgagagtcatggacctcccgcgcaagaacatgaagcacctgtggtttttccctcctgctggtgacagctcccaggacgggtcctgtcccaggtgcngcctccgagggagtccgggaccccggactaagtcgaacgcccgtcggacgacccctctccacctcacctgactaatcgtctcgtggatacttactaagttggggagttaggtttaattcggttcgggcctagggtaccgtccgggaccgacccgggaccccccgggggtaagggccgttaggggtacggtagggaccgttccgggaacgtcggaccgtacgttacccgtaacgtacgtaacgtagggttaacggaacggtaactaaacttaaggtaaccctaacgtaaacccgtttcccgaccccgttaacggaacggaaccggtaaccggtacgtacccccgtttaaccgttttacgggaaccggttacgggtaactaacccgggtaacccgtaaaacgtaaaacccgtttaaacccgtttacgtaccccgttaaacgtaaaccggtttaccgtaacccgttacccgttaccgttacccggtaaccccggcccggtaacccccgtaacgttaccccgggttaccttttaaccgtccgtacgttcggtaccgtacgtaccgtaccgtaaacacggtaactaacgtaattaaccgttattacgtacgttagttaacgtcgggttacgggacctaaccgggacccgtacgtaccctgtccgtaccgtacgtccccggtaactaccgggtcccaaccggtacccgtacggttccccgttaccctccccggg

SEQ ID NO: 70760 - DNA, 1011 bp, Homo sapiens
  misc_feature: GYAE6OF02JR4CJ.52.74.G08.1.454.CMB.1.raw
  modified_base (162)..(162): a, c, t, g, unknown or other
  misc_feature (162)..(162): n is a, c, g, or t
tcagcgcagtacgacacgaccggtgctcgatttagtagctctatcagggggctttctgagagtcatggacctcccgcgcaagaacatgaagcacctgttggtttttccctcctgcgtggtgaccacgtcctcccgaggtacggggtccctggtcccgtaggngcaggccttaccgagggacgggtcccggggaccccggtaactaagtaggaaccgccccggtaggaacgtaccccttctacctaacctccctaccgtgaactaacgtgtccgttcgaggtacctttattacgtaaaggtttggggaagttttaggtttaagttggttcgggtcccgttaggtaccggttccgggaccggaccccggggtaccccccggggtaaggggtcggtacgggtagggtccggtaacggccggaaccgtacggactaaccgtacccgtagacgtaagttacggggtaagaccgtaaaccgtaaactttaacacgtaaccgtaccggttacccctaccggttaacggacggttaaaccggaccggttaaccgtttaaccctttaccggtttttaaccggagggttaaccggggtaaaccaacccggttaaaaccgtaaaacccgtttaaaacccctttaccggtttaaccctttaaacgggttaaacgtttaaacccttacccgggttacccgttaacccgttacccggttaacccgggaacccccgtacccggtaaccccgttaccccgtaaacccgggtttcctttaacccggtttaaccgtcgggtaccggttaccggtaacggttccggtaaaaccctacgaaaccgttaacgttaacgttaaaacgtttattaaccgtttaaggtacgtttaaaccgtagggttaaccgggtaccggaccgggtaaacccgggttacccaccgtaccacccgtttccgtaccctaccggtaccctacccgaccccgttaacggcccgtaaccgtaccccgttacccggtccccgttacccgg

SEQ ID NO: 70761 - DNA, 770 bp, Homo sapiens
  misc_feature: GYAE6OF02JUG4C.52.74.G08.1.454.CMB.1.raw
  modified_base (108)..(108): a, c, t, g, unknown or other
  misc_feature (108)..(108): n is a, c, g, or t
  modified_base (325)..(325): a, c, t, g, unknown or other
  misc_feature (325)..(325): n is a, c, g, or t
  modified_base (598)..(598): a, c, t, g, unknown or other
  misc_feature (598)..(598): n is a, c, g, or t
tcagcgcagtacgacacgaccggtgctcgatttagtagctctatcagggggctttctgagagtcatggacctcccgcgcaagaacatgaagcacctgtggtttttccncctgctggtgacagctcccaggagggtcctgtcccgaggtgcagctccgaggacgtccgggccccggataatgaacgcccgtcggacgacccctcgtcactcacctgacatcgtctcgtgactatacgaagttgggagttggtttattacggttgggacctggtactccggccgaccggtcccccgggaaggggtcctagggacgtggacgtcgganaacggtccgacttccgactacgtagtacggtcgggaagaacctaagtaatacccggactaaacgtccccgtaccgtacgaacggacggaacggtaacgtaccttaccgtttacgacggtaacggacggtaaccgtaccgtaaacggtaaccctacgttacccgtacccgtaagtaaccgtcgtaaccgtccgtacaccggtccggacccgtccgaacccgtaccgtacctttaacgtacttcggtcgtaccggtacgtacgtaacgtaacccngaacgtaacctaacgttaatttacgttaagttagtaaccgttagtaccgggttacggacccgggttaacggaccccggttaacgaccgtaccgttaccggttcctaaccgtcccggttaaccacccgttaacgggcccggttaactccggttacccgtcccgttaccccggg

SEQ ID NO: 70762 - DNA, 704 bp, Homo sapiens
  misc_feature: GYAE6OF02FXNH0.52.74.G08.1.454.CMB.1.raw
  modified_base (290)..(290): a, c, t, g, unknown or other
  misc_feature (290)..(290): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggacgaccctctcactccacctgcaatgtctctggtatattcaagttgggagttgttattagttcggccgtggactccggcgaccggcccccgggaaggggcgnggaggtggacgtcggcagctactccatcgagtaggtaggagaacaataatcaactactcccgtccctacgagacggacgactctactttcgaggtgacgtacgtaccgaaacgtaacctacttccgtacctacgtaacttcgacctccgtacgtacgacccggccgtcccgaccgtaccgttaccctttagtaccgttgttacgcggtacgtacgtacgaccgacgtacgaaccttaaacttaacgtttaacttaacgttagtttagtaacgttacgggttacggggacccggtaacccggggttaccccgtaacgtacccgtacgttacccgttcccgtaaccgtccgtaccctacccgaaccggtaacccggtccccggtaaccgttccccggttcccccgttaacccccgg

SEQ ID NO: 70763 - DNA, 692 bp, Homo sapiens
  misc_feature: GYAE6OF02GYYTJ.52.74.G08.1.454.CMB.1.raw
  modified_base (628)..(628): a, c, t, g, unknown or other
  misc_feature (628)..(628): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgacaatgtctctggatattcaattgggagttggttattagttgggctggatccggcacgccccgggagggctggagtggacgtcggcgagcatccatcagtagtaggagaacaataatacaacaactccgtcctacgaggacgacgtagtcctactttcgaggtcgacgacgtaccaacgtaacctaattcctaccgtagtaaacttcgacccttctacgtaccgtacccgcccggtacccgacgtacccgttaccctttaacttaccgttcgtacggtaccgtacgaacggtacgaaacctacgtacacttaaaacttaacgtttaatttaagttacgtttaagtaagtttaacggtaccggggtacccgggtaacccgggtaccccggttactaacccgtcgttacccttacccgtaacncccggtaccctacccgtaaccggtacccggtaccctacgggttcccgttaccccgttcccccgg

SEQ ID NO: 70764 - DNA, 634 bp, Homo sapiens
  misc_feature: GYAE6OF02GU311.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcacggcccccgggaaggggctggacgtggatcggcagcatccatcatagtggagacaataatcaacaactccgtacctcgagacggacgtacgtcctaccttttcaggttggacgtacgtaccaaagaacctaattcctaccctagtaacttcgaccttctactcgacccgccgaccgacgaccggtccctttaactaccgtgtcgccgtacgtacgtacgaaccacgacgtacctaaattaacttaatttagtagtttagtaagttacgttcggggaccgacggggtaccccgtcaaccgtacttcctacccgtacgtaccgtccctacccaaccggaaccggtaccctacggttcccggttcccttcccccgg

SEQ ID NO: 70765 - DNA, 720 bp, Homo sapiens
  misc_feature: GYAE6OF02HBHH6.52.74.G08.1.454.CMB.1.raw
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
tcagcgcagtacgacacgaccggtgctcgatttagtagctctatcagggggctttctgagagtcatggacctcccgcgcaagaacatgaagcacctgtggttttcctcctgctggtgacagcctcccaggacggggtcctgtcccaggtgcagctccgagggcggtccggggaccccggataatcggaacgcccgtacggacgaccctctcactccacctgcaagtcgtctcgtaggtattattacgtaagttggggagtttaggttaattaggttcggccgtggtacgtcccggacgacccggggacccccggggtaagggcgtagggtacggtggacgtcggcagctatccatacaggtaggnggtaanactaaacgtacacactaacgtccgtacctacggaggacggacgtctacctaccgtttgaggtacgacgacgtaacaacgtaactaaccttcgtacctaagtaactcgtacctctacggtaccgacccgcccgtaccgacgtaccgttaccttacgtacgtcggtcggtaccgacgtacgtacgaaaccagtaaccgtactaaactttacgttacgtttagtagttacgtaaacggttcggtaccgggtaccgggtaccggtacccgtcaaccgtccttccgttaccaccgtaccgacctacccgtaaccggacccgttccgtaaccgttcccggtaccccgttccccgg

SEQ ID NO: 70766 - DNA, 988 bp, Homo sapiens
  misc_feature: GYAE6OF02HYKNF.52.74.G08.1.454.CMB.1.raw
  modified_base (122)..(122): a, c, t, g, unknown or other
  misc_feature (122)..(122): n is a, c, g, or t
  modified_base (218)..(218): a, c, t, g, unknown or other
  misc_feature (218)..(218): n is a, c, g, or t
  modified_base (386)..(386): a, c, t, g, unknown or other
  misc_feature (386)..(386): n is a, c, g, or t
tcagcgcagtacgacacgaccggtgctcgatttagtagctctatcagggggcttttctgagagtcatggacctcccgcgcaagaacatgagcacctgttggtttttcctcctgctggtcganacgcctcccaggacggggtcctcgtcccaggtgcgagctccgaggcggtccgggcccggactatagacgcccgtcggacgaccctctccactaccncctgacaatcgttctctaggattattacgtaaggttgggagttaggtttaagttacggttacggcgttacggacgttaccggccggtaaccccggggacccccggggtaaggggtacggtacggtacggggtacggtacggtcggacgacggtaccacgtacccgtanacgtacgtacggaaggaacaacgtaaacaacgtacctaacgtaaccttcccgtaccgacggtaacggaaccggtattacccggtaaccgttaccgtttaacggttacggtacgggtaaccggtaaaccgttaaccgaaaccgttaaacccgttaaacctttacccgtaaccggttaacggtttaaaacgttacccgtacccgttaccggttacccgtaaccccggggtaacccccggtcccggttaaacccgacccggttaaaccccgggtttaacccgtttaaccgtttaacggtccgttaccgggtacccggtaaaccgggtaacgttaaccggtaaccgtaaaccggaaacgtttaaacccgtaaacttttaaaaccgttttacgtttaacgttaacgggtttaaccgttaaagggttacccggtaacccggggttacccgggttaaaccccgggtaaacccccgttaaccgttcccgggtaaacccttcccggtttaccgtacccgggaaccccgttaacccccgtttaaccggtaaacccccggtacgggtaaccccccggttcggtttcccccccggtttaaccccgtcccccggg

SEQ ID NO: 70767 - DNA, 722 bp, Homo sapiens
  misc_feature: GYAE6OF02IE2SH.52.74.G08.1.454.CMB.1.raw
tcagcgcagtacgacacgaccggtgctcgatttagtagctctatcgagggggctttctgagagtcatggacctcccgcgcaagaacatgaagcacctgttcggtttttccctcctgcgtggtcgacagcctcccgaagggacggggttccctcgtcccgagggtcgcagtcctaccgagggacgtcccggggaccccggaataagtggaaccgccccgtagggacctacccctctaccacctccgaacctgacagtcgtctcgtaggaattacttacgagttgggattagttacttagttcgggctggactcccgcgaccggaccccgggaggcgtggagtggagtcggcgacgctactaccatacgagtaggtagacaactaagtaactcactacgtcctacccgagaacggtacgacgtacgtcgttacgtttacggagtacggaccgtaccgtaacgaacgtaactacgtacctaccgtatactactacctactccgtacgcccggaccgccgtaccgtacccgttaccttagtcgtacgtccgcgtaacgtacgtaaccgaactacgaagtacctaaacgttaactagttaatgtaagtaacgtcggtaaccgccgggtaacccggaccgttccacctacgttcccaccgtcctaccggacccctacccggacccggttaaccgcccgttaccggtaccgtcccccggttacccccgg

SEQ ID NO: 70768 - DNA, 1019 bp, Homo sapiens
  misc_feature: GYAE6OF02H3CWG.52.74.G08.1.454.CMB.1.raw
  modified_base (946)..(946): a, c, t, g, unknown or other
  misc_feature (946)..(946): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacacgctcccgaggtacggggtcctcgtcccgaggtgcgacgctccagggacggtcccggggccccggactaatgaacgtccctcggacgaccctctccactccacctgactaatcgtcttcgtaggtacttacgttactaaggttaggggtacggttggtttaacgttagttcgggccgttagggacgtccggtacgacccgggtacccccggggggaacgggtcggacgggttacgggtcggtacggttccgggaccgtacggtaccgtacgttaccctacgttacgtaacggttacggggttacgggaacggtaacgtaaaacttaaccgtaaccgtaaccgttaacccggttaccccgttaacccgtacccggtaacgggaaccgggaaccgttaccggtttaccccggttaaaccttttttacgggaccgggttacgggtaaacccggtaacccggttaacccgtaaaacggtaacccgttaaacccgttttacccgtaaccgttaacggttaaaccgttttaccgtacccttacccgttaccggtaaccccggttaaccccgggccccggtaaccccgggtacccgtacccggtttaccccgttttaaacggtttacccgtaccgggttccgggacccgggtacccggttaagggttaacaaccggaaccgtaaccggtaacctaaaatttaacccggtttagtttaacggttaacggttacgttaaagggttaccggggttaccgggtaacccggttaaccccgggttacccgtaacccgtacccggttacccttcccgggtacccttacggtaacccccnccccgttaacccggtaaaccggtacccggttaaccccggtacggttcccggtttaccccccttaaccccgggg

SEQ ID NO: 70769 - DNA, 772 bp, Homo sapiens
  misc_feature: GYAE6OF02JH1HQ.52.74.G08.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagcgcagtacgacacgaccggtgctcgatttagtagctctatcagggggctttctgagagtcatggacctcccgcgcaagaacatgaagcacctgtggtttttcctcctgctggtgacagctcccagacggggtcctgtcccaggtgcagcctccgaggacggtccgggaccccggactaatgacgccctcgganccctctcactcacctgcatctctctgattctctaagttgggtagttgttattagttcgggcctggtcgtaccggcgacccgggtaccccggggagggtctagggagtggacgtcggcgtancgtactaccgatccgagttacggacggaagaactaacgtaacaccgaatacccggttcctcccgtaagacgggaaacggtccgtaccgttacttaccgttttacggacggtacgggacgtaaccgtaccggtaaacgtaaccttaaccgttccttacccgtaagttaaccgtcgtaacccttccgtaccgtaccggtaccccggccccttaaccgggtacccgtacccggtttaccgttttaacgtacttccgggtaccggtccgtaacggtcggtaacccgaaacgtacccgaagtaaacttaaccggttaaacttttgttacgtagttaacgtaacggtttgggtaacccggtaccgggaacccgggtaccctacggtacctaacggttccctacgtaccgtcccgacctacccggacgtaccgtaccgtcgttaccccgtccctacccggg

SEQ ID NO: 70770 - DNA, 878 bp, Homo sapiens
  misc_feature: GYAE6OF02I1ATZ.52.74.G08.1.454.CMB.1.raw
tcagcgcagtacgacacgaccggtgctcgatttagtagctctatcagggggctttctgagagtcatggacctcccgcgcaagaacatgaagcactgtggtttttcctcctgctggtgacagctcccaggagggtcctgtcccgaggtgcagctccgaggagtccgggacccggataagtgaacgccctcggacgaccctctcacgtcacctgacaagtcgtcctcgtaggtacttacgttaccgtaaggttcggggtaaggttaggtttaacttttaacggttcgggtaccgttaggggtaaccgttccgggaccgaaccgggtaccccccgggggaaggggtccgtaagggaagggttacggacgttaccgggacgaacggtaccaacgttacccgtaacgtaccgtaagtaacgggttacgggaaacgtaaacgtaaactaaacgtaaccgtaaaccgtaaaccgttacccgttacccctaacggtaacggtacgggtaaaccggtaccgttaacccgttaaccgttttaccggtaacggttacgggtaaccggtaaccgtaaaccgtaaaacgtaaacccgttaaccgtttaacccggtacccgttaaggttaaacgttaccggaccctttaccgtttaacgacccggtaaccccgacccggtaccgtaaaccggtacccggttacctttaactaccgtcggtacgtacgtcgtaagtacgaaccgtacaacgtaacgttaaataacctttagttaaccgtattagtaagtacggtacggaaccgaccggtacccgtactaccgtaacgtccgtacgtaccgacgttacccgtaacgaccgtaaccgacccggtacttaccggttccctacccgg

SEQ ID NO: 70771 - DNA, 802 bp, Homo sapiens
  misc_feature: GYAE6OF02FQW8R.52.74.G08.1.454.CMB.1.raw
tcagcgcagtacgacacgaccggtgctcgatttagtagctctatcagggggctttctgagagtcatggacctcccgcgcaagaacatgaagcacctgtggtttttcctcctgctggtgacagctcccagagggtcctgtcccaggtgcagctccaggagtccgggccccggactaatgaacgccctacggacgaccctctcactccacctgacatgtcctctggatattactaagttgggagttggttaagttagttcgggtcctaggtactccgggcgaccggacccccggggaaggggccgtggacggtggagtcggcagctactccacttcgaagttaggtagggaacaaacgtaaactaaactaccgtaaactaacccgttaccccggtacccgtaccgaacggtaacgggaaccgtaacggttacccttaaccttttacgacggttacggaacgtaaccgtaaccgaaaccgtaaaccgtaacttacccgtacctaagtaactaccgtaccttcgttaccgtcgaaccccgccggtacccgtaccggtacccgttacccgttttaaccgacctttacgggtactaccggtccgaaggttaccgaaccgaaccgtactaaccgtaaattaaccgtttattaacgttagttacgtaaagtttacggtaccgggtaccggtaaccggtacccgtaaccgtacctaaccgttaccgttcccgtaaccgaacccttacccgtaaccccgtacccgggtaaccggtaccccgttggttacccccggttacccgttcccccggg

SEQ ID NO: 70772 - DNA, 646 bp, Homo sapiens
  misc_feature: GYAE6OF01C0LSJ.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagccctaagctcctgatctatgctgcatccagtttacaaagtggggtcccatcaaaggtctacgtaggtcggacgtaggtaggtactcggtacgggacgaaggttactttacctacttcctaccaacctactacgtaagttacgttacctaaaccctaaccgtaagtaaagtttacgttttacgaaccttaaacctttaaccttaacgttacgtaacaaacgtaagttaacgttaaccgtaacccttacccccgtacccgtaccttaccgttaccggtttaccgggacgggtaaccgggaacccggtaagggtacggtaagtaacgtaaacgaaacgtaacgtgggtcgtacgtcgaccaactattcgtcgttcgttaacc

SEQ ID NO: 70773 - DNA, 500 bp, Homo sapiens
  misc_feature: GYAE6OF01B1H80.3.19.B08.1.454.CMB.1.raw
  modified_base (215)..(215): a, c, t, g, unknown or other
  misc_feature (215)..(215): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccaggaaagcccctaagctcctgatctatgctgcatccagtttacaaagtgggtccatcaagttcagtgcagtgatctggacagatttcactctcacatcagtagtctacaactgaatattttgactaacttactactgtacaacagagttacgactacccctcgactccactttcggcggaggaccgaaggtggagatacgaaacgtaactggtcggctgactaccatctgttcttctacg

SEQ ID NO: 70774 - DNA, 540 bp, Homo sapiens
  misc_feature: GYAE6OF01BRASO.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtgcagtgatcgtggacagatttcactctcaccatcagtagtctacaacctgaagtattttgctaactttactacttgtacaacagtaagttacgaactaccccctccgtccttactaccgtttcgggcggacgggaacctaagggtcgggacgaacgtacgaaacggtaactaggtggacttcgacctaccatccttaggttccttctaccg

SEQ ID NO: 70775 - DNA, 495 bp, Homo sapiens
  misc_feature: GYAE6OF01E4W5Q.3.19.B08.1.454.CMB.1.raw
  modified_base (268)..(268): a, c, t, g, unknown or other
  misc_feature (268)..(268): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaancccctaagctcctgatctatgctgcatccagtttacaaagtgggtccatcaaggttcagtggcagtgatctgggacagatttcactctcaccatcagtagtctacaacctgaagtattttgactaacttactactgtacaacagagttacgactacccctcgctcactttcggcggacgggaccaaggtgagatacgaaacgaatgtggctgcacatctgtctctac

SEQ ID NO: 70776 - DNA, 510 bp, Homo sapiens
  misc_feature: GYAE6OF01EQPBV.3.19.B08.1.454.CMB.1.raw
  modified_base (266)..(266): a, c, t, g, unknown or other
  misc_feature (266)..(266): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaancccctaagctcctgatctatgctgcatccagtttacaaagtgggtaccatcaaggttcagtggcagtggatcgtgggacagtatttcactctcaccatcagtagtctaacaacctgaagtatttgactaacttactactgtacaactagtacgttacgactacccctccgctcctacgtttcggacggacggaccgaagggtcggagactacgaaacgtatggtggctgcacatctgtctctac

SEQ ID NO: 70777 - DNA, 484 bp, Homo sapiens
  misc_feature: GYAE6OF01AZ9I2.3.19.B08.1.454.CMB.1.raw
tcagagacgcactccacgaccggtgctcgatttagtgagtcagtaaggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaaggttcagtgcagtggatctggacagatttcactctcaccatcagtagtctacaacctgaagtattttgcaacttactactgtcaacagagttacgatacccctcgctcactttcggcgaggaccaaggtgagatcaaacgatgtggctgcacatctgtcttctac

SEQ ID NO: 70778 - DNA, 499 bp, Homo sapiens
  misc_feature: GYAE6OF01D02RJ.3.19.B08.1.454.CMB.1.raw
  modified_base (190)..(190): a, c, t, g, unknown or other
  misc_feature (190)..(190): n is a, c, g, or t
  modified_base (265)..(265): a, c, t, g, unknown or other
  misc_feature (265)..(265): n is a, c, g, or t
  modified_base (495)..(495): a, c, t, g, unknown or other
  misc_feature (495)..(495): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaaattggtatcagttcaaacaggaaanccctaagctcctgatctatgctgcatccagtttacaaagtgggtccatcaaggttcagtggcagtggatcgtgggacagatttcactctcacatcagtagtctacaacctgaagtattttgactaactttactactgtacaaactagtagttacgactacccctccgctctactttcggacggaggaccaaggtggagatacgaaacgtatgtggctgcacatctgtctntacc

SEQ ID NO: 70779 - DNA, 664 bp, Homo sapiens
  misc_feature: GYAE6OF01BO6E4.3.19.B08.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (302)..(302): a, c, t, g, unknown or other
  misc_feature (302)..(302): n is a, c, g, or t
tcagagacgcactccacgaccggtgctcgatttagtgagtcagtaagggggaggaccgagtctcagtcgaggaccacacgcgattggacattgagggttccccgctcagctcctggggcctcctgctactctggctccgtaggatgccagatgtgtacctacccgaggtatttaggacccagtctccatcctccctgtctgcatcgtgggtgggagtacagacgtcgatcatctcttgccgggnaagtcagngtgttacgtacctggttgcctggtatcagcaggacgccggaagggaaccncccccgtaacgtccggtaggactcgtagtgactcgacctcgtagtttggacgtaagggtcgggtcccagtacgaaggttcaggtccggcgtagggtcggtacgtcggtaggggacctaaggtaacttccacttcaccaacctatacagacacgccctggcctacgtccttagtaattaggttacttttacgacctttaaacttttagtaaccgtcgaacccgtaacgtaacgttaacttaaaccgttacccgtggttaccgtaccggttaccgggacctaaaagggggaccctaaagggggtgaacgtacgtcccgaacgtaacggtaccgttggttacggtccttacggaccctcggtacg

SEQ ID NO: 70780 - DNA, 493 bp, Homo sapiens
  misc_feature: GYAE6OF01DQTPK.3.19.B08.1.454.CMB.1.raw
  modified_base (485)..(485): a, c, t, g, unknown or other
  misc_feature (485)..(485): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaagccctaagctcctgatctatgctgcatccagtttacaaagtgggtccatcaaggttcagtggcagtgatctgggacagatttcactctcacatcagtagtctaacaacctgaagtatttgactaacttactactgtacaacagagttacactacccctcgctctactttcggacggaggaccaaggtggagatacgaaacgactggtgctgacacatctntcttctac

SEQ ID NO: 70781 - DNA, 560 bp, Homo sapiens
  misc_feature: GYAE6OF01EZ4YX.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaagtgggtcccatcaaggttcagtggcagtggatcgtgggactagtatttcactctcacatctagtagtctacaacctgaagtatttagactaacttactactgtacaactagtacgttacgactacccctccgtactacgtacctttcgggccgggtaagggtaccgaagggtcggtaacgaacgtaaccgaaaacggtaacgttcggtacggtacctggacctaacccgtattaccgttcgttccgttcctaacg

SEQ ID NO: 70782 - DNA, 507 bp, Homo sapiens
  misc_feature: GYAE6OF01DKRTB.3.19.B08.1.454.CMB.1.raw
  modified_base (347)..(347): a, c, t, g, unknown or other
  misc_feature (347)..(347): n is a, c, g, or t
  modified_base (504)..(504): a, c, t, g, unknown or other
  misc_feature (504)..(504): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaaattggtatcagttcaaaccagggaaagcccctaagctcctgatctatgctgcatccagtttacaaagtgggtcccatcaaggttcagtggcagtggatctggacngatttcactctcacatcagtagtctaacaacctgaagtattttgactaactttactactgtacaaacagtagttacgaactacccctaccgcttacacgtttcggcggagggaccaaggtggagatacgaaacgaatggtgctgcacatctgtcttntac

SEQ ID NO: 70783 - DNA, 526 bp, Homo sapiens
  misc_feature: GYAE6OF01AJJ6P.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttattaattggtatcagttcaaaccaggaaagcccctaagctcctgatctatgctgcatccagtttacaaagtgggtcccatcaaggttcagtggcagtggatcgtggacagtatttcactctcaccatcagtagtctacaactagtaagtattttgactaacttactactgtacaactagtagttaccgtactaccccctccgtccttactaccgtttacgggaccggacgggaaccgtagggtggacgtatacgaaacgacgtggtggctgactaccatctctcttctaccg

SEQ ID NO: 70784 - DNA, 493 bp, Homo sapiens
  misc_feature: GYAE6OF01D1S5D.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtcccatcaaggttcagtggcagtggatctgggacagatttcactctcaccatcagtagtctaacaacctgaaagtattttgctaacttactactgtcaacagagttacgactacccctcgctcactttcggcgaggaccaaggtgagatcgaaacgatgtgctgacaccatctgtcttctac

SEQ ID NO: 70785 - DNA, 561 bp, Homo sapiens
  misc_feature: GYAE6OF01EJ1D8.3.19.B08.1.454.CMB.1.raw
  modified_base (268)..(268): a, c, t, g, unknown or other
  misc_feature (268)..(268): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttcaaacagggaaanccctaagctcctgatctatgctgcatcctagtttacaaagtcgggtccatcaaggttcagtggcagtgatcgtggacagtatttcactctcacctatcagtagtactaacaacctgaagtatttacgactaacttactactgtacaactagtacgttaacacttaacccctccgcttaccgtaccgtttcgggccggaacgggtaaccgaagggtcgaacgtaactaaccgaaacgtaacgttggtacggactacggacctaaccgtattaccgtcgttcccttcgtaacccg

SEQ ID NO: 70786 - DNA, 561 bp, Homo sapiens
  misc_feature: GYAE6OF01COT4B.3.19.B08.1.454.CMB.1.raw
  modified_base (268)..(268): a, c, t, g, unknown or other
  misc_feature (268)..(268): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttcaaaccagggaaacnccctaagctcctgatctatgctgcatcctagtttacaaaggtcgggtccatcaagttcagtggcagtgatcgaggacagtatttcacttctacacctatcagtacgtactacaacctagaagtattttagactaactttactactgtacaactagtacgttacgactacccctccgcttacgtacgtttccgggacggtacgggtaacccgtaagggtcggaagacgtaacgaaaacggtacttggtcgaccgtagacctaacccgtattaccgttcgttcctttccgtaccg

SEQ ID NO: 70787 - DNA, 621 bp, Homo sapiens
  misc_feature: GYAE6OF01BUUHI.3.19.B08.1.454.CMB.1.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
tcagagacgcactccacgaccggtgctcgatttagtgagtcagtaagggggagccagggtctcagtcaggacacagcagtggacatgagggtccccgctcgagctcctggggctcctgctactctggctccgagatgccagatgtcgacacccagatgacccagtctccatcctccctgtctgcatctgtggganacagagtcatcatctctgccggnaagtcagtgtgttagttatttattaattgtatcagttacaaacgaggaaacaccctaagctcctagacttctatcgctgacactacctagtttaacgaaaggttcgggtaccctagttacgtaaaggttcgaacgtcggacgtaggtggatcgtacgggactacgtactttcacttctacacctactctaagttacgtactaactaaccgtagtaagttatttacgacttaacgttactactagtacaactagtacgttacgaacttacccgtcgtacttaccgtacgtttcggacgggtacggtaaccgtaagggtacggaacgtaacgtaaccgtaaacggtacgtacggtcggacgtacgaccctaaccgtacgttacgttacgttcctttcgtaacccg

SEQ ID NO: 70788 - DNA, 852 bp, Homo sapiens
  misc_feature: GYAE6OF01BCCUK.3.19.B08.1.454.CMB.1.raw
  modified_base (842)..(842): a, c, t, g, unknown or other
  misc_feature (842)..(842): n is a, c, g, or t
tcagagacgcactccacgaccggtgctcgatttagtgagtcagtaagggggagccagtctcagtcaggacacagcatggacatgagggtccccgctcagctcctggggctcctgctactctggccctcgatagtcgacgagtagtgtacgaacccaccgaagtagtacccgaacccgtacgttccctacctaccttcccccttcccgttcgttcgtcgactacttcgttggggtagggaacgaacgaaggtacgtactactactacttcctttcggtccggggaccggtaacgtaacgtacgaaggttaggtttaggtttaagtttttaatttttaaaagttttaagggttagttactacgtttaacgttaaacccaaaaccggggtaagggtaaccccctaacccgtagtccccttacggtatacttacttagtccgtcgtacgacttaccgtaacgtttaacggttaaacggtaacgggggttccccgtaaccctaagttaacgggttaacggttaggtacggggtcgtaacggtagggtagttacgttcggggaacggactaagttttaccttaccgtaccgttctaacccacgttaacgtaccggtaaggtttaccttaacccgtaaacccttaaggtaagttaattttacgtaccgaaccctttaaaccttacgtagttaaccgaactaacggtaagtttaaccggtaacctacccccttacccgtcgtaccttacggttccgggttacgggaccggggtaaccgtaaggagggtacgaactaacgtaaaccgtaacggtggtggtcgaccgacgtacctaactgttacgtcttacnccgttacccg

SEQ ID NO: 70789 - DNA, 539 bp, Homo sapiens
  misc_feature: GYAE6OF01ASBZG.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaagccctaagctcctgatctatgctgcatccagtttacgaaagtgggtccatcaagttcagtggcagtggatcgtggacagatttcactctacaccatcagtagtactaacaactagtaagtatttttagactaacttaactacttgtacctaacagtacgttacgtaacctacccctccgtctacctactttccggacggtacggaccgtaaggtcggagacgtacgaaacgtacgtaggtggactgacctaccgattacctcgtcgttctaccg

SEQ ID NO: 70790 - DNA, 749 bp, Homo sapiens
  misc_feature: GYAE6OF01C901J.3.19.B08.1.454.CMB.1.raw
  modified_base (293)..(293): a, c, t, g, unknown or other
  misc_feature (293)..(293): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatcgacccagtctccatcctccctgtctgcatctggtgggagacagagtcatcatctctcggccggacaagtcagtagttgttaagttaattttaattttaaagttggtaattcgtaagtttacaaaaccgtaggggaaacncccctaaagcctcctagattctatgctgctatcctaagtttaacgaaacggtcgggtaccccaagttacgaaggttcaggtcggactaggttggaattcggtaggggactacggttactttaccgaccttactaccaaccgtattacgtaacggttaacgtaccttaacgtaaacccgttaggtaaacgtttacgttttacgacccttaaacgtttacgtaaccgttacgttaaccgaaacgtaaggttaaccgtttaacccgtacccgttaacccccccgttcccgtaaccgttacccttaaccgggtttaccggggaccggggtaaacggggtacccgaaagggggttaccggaaacggttaaaccgtaaccgtaaaaccggtaaccggttcggtacgggtacccttacgggaaccctaacgtaactttccgtcgtttaccctacgttaccccg

SEQ ID NO: 70791 - DNA, 507 bp, Homo sapiens
  misc_feature: GYAE6OF01BLD71.3.19.B08.1.454.CMB.1.raw
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaggtcagtgcagtgatctggacagatttcactctcaccatcagtagtctaacaacctagaagtattttgactaactttaactactcgtacaacagtagttaacgactacccctccgctcctaccgtttcggacggacgggaccgaaggtgacgatacgaaacgaatggtgctgctacatntntctntac

SEQ ID NO: 70792 - DNA, 633 bp, Homo sapiens
  misc_feature: GYAE6OF01DH4VD.3.19.B08.1.454.CMB.1.raw
  modified_base (429)..(429): a, c, t, g, unknown or other
  misc_feature (429)..(429): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgaccagtcctccactccctccctgtctgcatctggtgggagacagagtcatcatctcgttggccgggacaagtcgagtagttgttagttaatttaatttaaagttggtatactagttaaccaaacgaagggaaacctaccctaagcctactgactctatgctgctactcctaagtttaacaagggtcggaccatacgaaggttcaggtgacgagtggatcggtggacagttattcacttcacactatctagtactaccaactaacctagaaatttntttcgaaccttaaactttaccgtactagtaacctaaagtaggttaacgtttaccgaaccctttacccccgtcccgtaccttaccgttaccggtttccgggacgggtaccggaaccgtaaggggttcgaagtacaaccggtaaaacgtacggttgggtacggactaccgacctaaccctattcccgttagtccctttcgtaaccc

SEQ ID NO: 70793 - DNA, 632 bp, Homo sapiens
  misc_feature: GYAE6OF01DG2FA.3.19.B08.1.454.CMB.1.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (351)..(351): a, c, t, g, unknown or other
  misc_feature (351)..(351): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagttattttatttaaattggtattcagttacaaacaggaaacnccctaagctcctgatctatgctgctatcctagtttaacaaaggttcgggtacccatcaaggttcagtggcaggtgatcgngggacagtattcacttcacactactcaagttacgtactaactaaccgttagtaaagttacttttgaaccttaactttaacctacttaggtaacctaaacgtaacgtaacgtttaaccgtaaccttacccccgttccggtaccttaccgtaaccggttttaccgggacggggtaacggggtaaccgtaaagggttacgggagtaaacgtaaccgaaaacggtaaccgtgggttcggacctcgacccgtaacctaagttcccgttcgttaccttcgttaaccg

SEQ ID NO: 70794 - DNA, 561 bp, Homo sapiens
  misc_feature: GYAE6OF01E0NDW.3.19.B08.1.454.CMB.1.raw
  modified_base (267)..(267): a, c, t, g, unknown or other
  misc_feature (267)..(267): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattatttaaattggtatcagttcaaaccagggaaancccctaagctcctgatctatgctgcatcctagtttacaaagtgggtccatcaagttcagtggctagtggatcgtggacagtatttcactctcacctatcagtagtctaacaactagtaagtattttcgactaacgtttactactcgtacaaacagtaacgttacgactaacccctccgccttacgtacttttaccgggacggtacgggaaccgtaaggggtacgaacgtagtaacgaaaacgtaacgtcggtgggtacctagacctaaccgtattccttcgttcttccttaccg

SEQ ID NO: 70795 - DNA, 501 bp, Homo sapiens
  misc_feature: GYAE6OF01CE78J.3.19.B08.1.454.CMB.1.raw
  modified_base (267)..(267): a, c, t, g, unknown or other
  misc_feature (267)..(267): n is a, c, g, or t
  modified_base (354)..(354): a, c, t, g, unknown or other
  misc_feature (354)..(354): n is a, c, g, or t
  modified_base (407)..(407): a, c, t, g, unknown or other
  misc_feature (407)..(407): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaacncccctaagctcctgatctatgctgcatccagtttacaagtggtccatcaaggttcagtgcagtggatcgtggacagtatttcactcncacatacagtagtctaacaactgaagtatttgactaacttactactgtacaanagattacgactacccctcgactctacgtttcggacggacggacctaaggtgaagagtacgaaacgataggtgactgacactatctgtcttctac

SEQ ID NO: 70796 - DNA, 539 bp, Homo sapiens
  misc_feature: GYAE6OF01EODR9.3.19.B08.1.454.CMB.1.raw
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattttatttaaattggtatcagttacaaaccagggaaacgcccctaagctcctgatctatgctgcatccagttacaaagtgggtccatcaaggttcagtggcagtgatcgtgggacagtatttcacttctacacatctagtagtctaacaacctgaagtattttgactaaccttactactntaccaanagtacgttaacaccttacccctccgtctcctacgtttcggcggacgggtaaccgaggtggaagtactaacgaaacgtaacgtaggtcggactgaccgacctatccttgttccttctaccg

SEQ ID NO: 70797 - DNA, 512 bp, Homo sapiens
  misc_feature: GYAE6OF01COSLR.3.19.B08.1.454.CMB.1.raw
  modified_base (190)..(190): a, c, t, g, unknown or other
  misc_feature (190)..(190): n is a, c, g, or t
  modified_base (336)..(336): a, c, t, g, unknown or other
  misc_feature (336)..(336): n is a, c, g, or t
  modified_base (490)..(490): a, c, t, g, unknown or other
  misc_feature (490)..(490): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacaggaaagcccctaagctcctgattctatgctgcatccagtttacaaagtgggtccatcaagtcagtgcagtgatcgnggacagatttcactctcactatcagtacgtctacaactgaagtatttagtaacttatactgtacaatagattacgactaccctcgtctccgtactttcggacgtagggacaggtagagactacgaaacgtaacgtgaggtctacgacaaccgtnttactgttcctctacttccccg

SEQ ID NO: 70798 - DNA, 771 bp, Homo sapiens
  misc_feature: GYAE6OF01ALTQR.3.19.B08.1.454.CMB.1.raw
tcagagacgcactccacgaccggtgctcgatttagtgagtcagtaagggggagccagtctcagtcaggacacagcatggacatggagggtccccgctcagctcctggggctcctgctactctggctccgagatgccagatgtgacacccagatgacccagtctccatccctccctgtctgcatcgtggtgggagacagtagtcatctattctcgttcggaccggactaaggtcgaggtacgttaggttagttaattttaatttaaacgttggtaatacgtaagttaccgaaaaccgtaagggaaacctcccgtaacggtcctacgtgtatcctagtcgtcgtacggctacttaccgtaagttaacgaaggttccgggtacctaagtacgtaaggttccaaggtcggactaggtaggtactcggtacgggaactacggttactttacctacgttaccctaacctaccgtacgttacgtaaagttaccgttaaccttaacccggtaaacccgtttaaggttaacgtttacgttttaccgaacctaaaccgttttaacgtaaccgtttacgtaaacctaaaccgttaagtaaccggtttaacccgtacccgttacccccgtaccgtactttacccgtaaccgggtttccggaacgggtaaccgggtaaccgttaaagggtccgtaaagtaccgtaaaccggtaaacgttacggttacggtcggtacttaccggacccttaactacggtagttcccgttacttcccgttacccgg

SEQ ID NO: 70799 - DNA, 590 bp, Homo sapiens
  misc_feature: GYAE6OF01EQTUF.3.19.B08.1.454.CMB.1.raw
  modified_base (196)..(196): a, c, t, g, unknown or other
  misc_feature (196)..(196): n is a, c, g, or t
tcagagacgcactccacgaccggtgctcgatttagtgagtcagtaagggggagccgagtctcaagtcaggacacagcaatggaccagtgagggtccccgctcagctcctggggctcctgctactctggctccgagatgccagatgtgacacccagatgacccagtctccatcctccctgtctggcatctgtggganacaggagtcaatcattctcttgaccgggcaagtcagagtgttagtatttatttaaattggtatcagttcaaacaggaaagcccctaagctcctgatctatgctgacatccagttacaagtggtccatcaagttcagtgcagtgatctggacagtatttcactctacaacctatacaagtagtactaacaaaccgtgaaagtattttacgactaactttaactactacttaccaagacgtaacgttaaccgacttaccccttaccgtcttaccgtaccgttttccgggacggtaacggggtaaccctaaagggtacgacgtaacgttaaccgaaaacgtaacgttcggtacggtcttacggacctaccgacgttacctcgttcctccgttaaccg

SEQ ID NO: 70800 - DNA, 544 bp, Homo sapiens
  misc_feature: GYAE6OF01EHPR4.3.19.B08.1.454.CMB.1.raw
  modified_base (338)..(338): a, c, t, g, unknown or other
  misc_feature (338)..(338): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctcctgtctgcatctggtgggagacagagtcatcatctcttgccgggcaagtcagagtgttagtatttatttaaattggtatcagttacaaacagggaaagcccctaagctcctgatctatgctgcatccagtttacaaagtgggtccagtcaaggtcagtgcagtgatgnggacagatttcatctcacatacagtactctacaactagaacgtatttcgactaacttactactgtacaactagtacgttaacgactaacccctccgtcctactacgtttcggacggagggaccgtaaggtggagtaactaaccgaaacggtaaacctggtcggtacgtacgacctacccgtaacttctaggttccttcgttaaccg

SEQ ID NO: 70801 - DNA, 636 bp, Homo sapiens
  misc_feature: GYAE6OF01CVPW5.3.19.B08.1.454.CMB.1.raw
  modified_base (277)..(277): a, c, t, g, unknown or other
  misc_feature (277)..(277): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatcgtggtggagacagagtcaatcattctcgttcggccgggacaagtcagagttgttagttatttatttaattggtatcagttacaaacgaggaaacnccctaagctacctagatctatgctgacatacctaagtttacaaggtcgggtaccagtacgaagttcaggtgcagtgatgaggacagtacttcactctacaccatacctagtacgtactaactaacgtagtaattactttacgaactttaactttaacgtacgttacgtaactaacgtaacggtaacgtttaaccgaacccttaccccgttaccgtaccttaccggttaaccgtttaccggggaccgggtaacgggtaacccgtaaggggttacggaaagtaacgtaaaccggtaaaacggttagtacgggtcgtacgtacgacctaaccgtacgttagttacgtccgtttacttacccg

SEQ ID NO: 70802 - DNA, 551 bp, Homo sapiens
  misc_feature: GYAE6OF01ANCBF.3.19.B08.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggnagtcagagtgttagtatttattaaattggtatcagttcaaaccaggaancccctaagctcctgatctatgctgcatccagtttacaagtcgggtccatctaaggtcagtggcagtgatcgtagggactagtactttcactctacacctatcagtagtctacaactgaagtatttacgactaacttactactcgtaccaactagtaacgttaaccgaccttacccccgtaccgtactaccttaccgtttcgggaccggtagggacccaagggtcggacacgtaccgaaacggtacttagggcgtctacgacctacctatcgtcgttccgttctacccg

SEQ ID NO: 70803 - DNA, 598 bp, Homo sapiens
  misc_feature: GYAE6OF01D5DVT.3.19.B08.1.454.CMB.1.raw
  modified_base (191)..(191): a, c, t, g, unknown or other
  misc_feature (191)..(191): n is a, c, g, or t
  modified_base (271)..(271): a, c, t, g, unknown or other
  misc_feature (271)..(271): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttgccgggcaagtcagtagtgttagttatttatttaaattggtatcagttacaaacgaggaacnccctaagctctgatctatgctgcatactagtttaacaaaggtcgggtaccatcaaggttcagtggcagtggatcgtggacagtatttcactctacacctatcagtactactactaacctgtaagttatttacgactaactttactacttacgtactaaacgtagtaacgttaacgtaaccttacccccgtccgtacccttacgttaccgtttccgggacgggtacgggaaccgtaagggtggaacgtaactaaccggtaaaacgtaacgttgggtacggaccgttcgaacccgtacctagttacccgttcgttccttacgtaacccg

SEQ ID NO: 70804 - DNA, 517 bp, Homo sapiens
  misc_feature: GYAE6OF01DNE94.3.19.B08.1.454.CMB.1.raw
  modified_base (266)..(266): a, c, t, g, unknown or other
  misc_feature (266)..(266): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttcaaacaggaaacnccctaagctctgatctatgctgcatccagtttacaaagtgggtcccatcaaggttcagtgcagtgatcgtggacagtatttcactctacaccatacagtaagtctaacaactgaaatattttgactaactttactactgtacaacagtaacgttacgaactacccctccgctactacgtttcggacggacgggaccaagggtgacgtaataccgaaaacgtactggttcggctgacacatctgtcttctac

SEQ ID NO: 70805 - DNA, 537 bp, Homo sapiens
  misc_feature: GYAE6OF01ALK2U.3.19.B08.1.454.CMB.1.raw
  modified_base (267)..(267): a, c, t, g, unknown or other
  misc_feature (267)..(267): n is a, c, g, or t
  modified_base (352)..(352): a, c, t, g, unknown or other
  misc_feature (352)..(352): n is a, c, g, or t
  modified_base (378)..(378): a, c, t, g, unknown or other
  misc_feature (378)..(378): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccgggcaagtcagagtgttagtacctggttggcctggtatcagcagaagccagggaacncccctaactcctgatctatgatcgcctcctagtttggactaaggtcgggtacccagtacaacggttcaggcggacagtggatcgnggacagaatcactctcaccatcagcngcctgacagcctgattgtattttcgacttaacttattactcgaccctaatagttaactaaccgtacccgtcgttacgtaccggttaccggaccgtaaaccgggacctaaggggtcggaagatccgaagttaaccgagtcggtggacctgcctacgtacg

SEQ ID NO: 70806 - DNA, 596 bp, Homo sapiens
  misc_feature: GYAE6OF01A3Y4A.3.19.B08.1.454.CMB.1.raw
  modified_base (250)..(250): a, c, t, g, unknown or other
  misc_feature (250)..(250): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccgggcaagtcagagtgttagttatttatttaaattggtatntagttacaaacaggaaacacccctaagctcctgatctatgctgctactcctagtttaacaaaggtcgggtaccagtacaaggttcagtagcaggtgagtcgtggactagtactttcactctacactactcagttactactaacaactagtaagtatttgacttaacttactactagtacaaactagtacgttaacgtacctaccccgtcgtaccgttaccgttacgtttaccgggaccgggtaacgggtaaccgtaagggttacgaacgtaaacgtaaccgtaaaacgtaacgtcgggtacgacgtacgaccctaacgtacttacgttcgttccttacggttaccc

SEQ ID NO: 70807 - DNA, 518 bp, Homo sapiens
  misc_feature: GYAE6OF01DARYI.3.19.B08.1.454.CMB.1.raw
  modified_base (270)..(270): a, c, t, g, unknown or other
  misc_feature (270)..(270): n is a, c, g, or t
  modified_base (344)..(344): a, c, t, g, unknown or other
  misc_feature (344)..(344): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagttatttatttaaattggtatcaagttcaaaccaggaaacnccctaagctcctgatctatgctgcatccagtttacaaagtcgggccatcaagttcagtgcagtgatcgtggacngtattcactcacacatcagtactctaacaactagaacttatttcgactaactttctactgtaacaacagtagttacgaacctacccgtcgactctacgttcgggacgtacggacaagggtggaacataacgaaacgtagtggtcggctcgactaaccattcctatccttcgtac

SEQ ID NO: 70808 - DNA, 681 bp, Homo sapiens
  misc_feature: GYAE6OF01D7TPH.3.19.B08.1.454.CMB.1.raw
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctctgccggnaagtcagagtgttagttatttattaattggtatctagttacaaacgaggaaacnccctaagcttacctgactctatgctgactatcctaagtttaacgaaaggtcggtaccagtacgtaagttcgaggtggactaggtaggtactcggtaggaactagttactttacaccttcgtacctaacctaagtactaagttaacgtaccttaaaccgtaaccgttagtaaacgtttacttttacgaacctttaaactttactaaccgttacgtaacctaaacgtacggttaaaccgttaaccgtaacccgttaccccctaccgtacttacccgttaccgtttacggggaccggtaacgggtaccgtaaaggggtacgaaacggtaacgtaaaccgtaaaaccggtacgttacggtaccggtaccgtacgaccctaaccgttacgttaccgttcgttcgttacccttacccg

SEQ ID NO: 70809 - DNA, 649 bp, Homo sapiens
  misc_feature: GYAE6OF01D7SJ2.3.19.B08.1.454.CMB.1.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
  modified_base (457)..(457): a, c, t, g, unknown or other
  misc_feature (457)..(457): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggnaagtcagtagtgttagttatttatttaaattggtatctagttacaaacagggaaacnccctaagctcctgatctatgctgcatcctagtttaacaaaggtcgggtaccctagtacgtaaggttcaaggtggactaggttggacgttcgtacggggaactaggttactttaccgtaccgttacctaccaaccctaataccgtaacggttaacgtaccttaaaccgtaaaccctggtaaagttnttttacgaccttaaactttactactcgtacaacgtagtacgttaaccgaccttacccccgtccgaccttccgtaaccggtttccgggacgggtaacgggaccgtaagggtcggaacgtaactaaccggaaaacggtagttgggtcggtacttacggacctaccgtatcgttaccgttccttacgttaccccg

SEQ ID NO: 70810 - DNA, 601 bp, Homo sapiens
  misc_feature: GYAE6OF01EZE40.3.19.B08.1.454.CMB.1.raw
  modified_base (364)..(364): a, c, t, g, unknown or other
  misc_feature (364)..(364): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcttgccgggcaagtcagagttgttagtattttaatttaaattggtatctagttacaaaccgagggaaacgacccctaagcctacctgatctatgctgctatactagtttacgaaaggtcgggtcccatacgtaaggttcagtggactagtggatcgngggactagtatttccactctcaacctntctagtntactaacaactagtaagttatttacgactaacttactactacgtactaacgtagtacgttaacgacctacccctaccgtaccttccgttaccgtttacgggaccggtaagggaacccgtaagggttacggagtaacgtacgtaaaacgtagttacggtcggtactacggacctaaccttataccgttcgttccttcgtacccg

SEQ ID NO: 70811 - DNA, 848 bp, Homo sapiens
  misc_feature: GYAE6OF01D4ET8.3.19.B08.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
tcagagacgcactccacgaccggtgctcgatttagtgagtcagtaagggggacgccagtctacagtcaggacacagcatggacagtgagggtccccgctcagctcctggggcctcctgctactctggctccgagatgccagatgtgacacccagactgacccagtctccatccctccctgtctgcatcgtgtaggganacagactcatcattctacttgccgggnaagtcaagtagttagttagttaatttaatttaaagttggtaactacgtaagtttaccaaaaccgtaagggtaaaccgtacccccgttaaagccgttacccgtaggtacttaccgttaagttcggtacctacggtacctaaccgttaaccctaaggtttttaaaaccgaaaacgggttacccgggggttaccccctaagttacccgtaaaggggtttaccaagggtttacggaccgtaaggttagggtaacgttacggttacggggaacaaacgggttaacgttttacccgaacgtttacccgtacccgtaaaccgtagttaacccgtaaggtttaaccggtttactaaacccgtaaacccgttagttaaacgttaacgtttttacgaacctttaaacccgttttaaccgtaaccgtttacggttaaccgaaacggtaaggttaaccgtttaaccgggtaacccttaaacccccgtccgtaccgtttaccgtaaccggtttccggggaccgggtaacggggacccgtaaagggttacggtaaacgtaacgtaacccgtaaaacgtaagtcgggttacgtccgtagtaccctaactacgttaccgttacgttacttcgtaacccg

SEQ ID NO: 70812 - DNA, 706 bp, Homo sapiens
  misc_feature: GYAE6OF01AE6SR.3.19.B08.1.454.CMB.1.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctcttggccggnaagtcagagttgttaagttattttaattaaattggtatcaagttacaaaccgagggaaacnccctaagctcctgatctatgctgactatcccgtaagtttaaccgaaaggttcgggtacccctaagtaccgtaaagggtttccgaaggttcggacgtaaggttacgggtattcggtaggggaactaaggttacttttaccgaccttccgtacctaacccgtagttaccgtaacgtttacgttaacccttaaacccgtaaacccgttaaggtaaacgtttactttttacggaaccttaaaccgttttaaccttaaccgttagtaacccgaaacgtaagtaaccgtttaaccgaacccttaaccccccgtccgtaccttaccgtaccgtttacgggaccgggtaacgggaacccgtaaggggtcggaaagtacgtaaccgaaaacgtacgtggtcggctacggacctacctagttccttacgttcttccgtacc

SEQ ID NO: 70813 - DNA, 654 bp, Homo sapiens
  misc_feature: GYAE6OF01BF5ES.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctgtgggagacagagtcatcattctcttggcccgggcaagtcagtagtagttagtattttaatttaaattggtatctagttaccaaaccgaggaaacgcccctaagcctctgatctagtgctgcatcctagtttacaaggtcgggtaccatctaagttcagtgcgagtgagtcgtaggactagtactttcactctacacctatactaacggttacgttaccctaactaacccgtagtaaacgttagttttcgaacccgttaacctttaacgtaccttacgtaacctaactaacgtaacgtttaaccgaaccttaccccctcccgtaccttacgttaccggtttaccgggacgggaaccgggtaacctaaggggtacggaacgtaacgttaacccgaaacggtaacgttacgggttcggaccgttacggaccctaacccgttacgttaccgttacggttccttacccgtaccg

SEQ ID NO: 70814 - DNA, 585 bp, Homo sapiens
  misc_feature: GYAE6OF01DBI7D.3.19.B08.1.454.CMB.1.raw
  modified_base (226)..(226): a, c, t, g, unknown or other
  misc_feature (226)..(226): n is a, c, g, or t
  modified_base (573)..(573): a, c, t, g, unknown or other
  misc_feature (573)..(573): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatcgacccagtcctccactccctccctgtctgctatcgtggtgggagacgagagtcatcatctcgtcgccggganaagtcgagtagttgttaagttaatttaatttaaagttggtatactagttacaaacgagggaactccctaagctcctagtatactatgctgactactacgtaagtttaacgaaagggtcgggtacctagtacgtaaggttcaggtcgacgtagtggtactgtaggaacagttacttcactctacactatacagtacgtactaacctaagtgaaagttattcgaacctaacttaacgtactacgtacaacgtagtaacctacgtacctaccctcgtaccttcgtacgttcgggacggacgtacgaggtcgaatacgaacgaaacgacgtgtcggactgacctactattnactctaactccg

SEQ ID NO: 70815 - DNA, 587 bp, Homo sapiens
  misc_feature: GYAE6OF01B0SG9.3.19.B08.1.454.CMB.1.raw
  modified_base (267)..(267): a, c, t, g, unknown or other
  misc_feature (267)..(267): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagtagtgttagtatttatttaattggtatcagttcaaacagggaacnccctaagctcctgatctatgctgcatcctagtttaccaaaggttcgggtacccatcgaaggttcaggtggacagtggatcgtggacagtactttcacctctacacctatcaagtacgttactaaccaacccgttagaagttattttacgaccttaaactttacctaactcgtaaccaaactagtaacgttacgaacctaccccgtcctcctaccgttacgtttccgggacggacgggtaccgtaagggtcggtaagacgtaccgaaacgtacgtggtacggctacggccctaaccgtacttccgtcgttcttccgtaccg

SEQ ID NO: 70816 - DNA, 602 bp, Homo sapiens
  misc_feature: GYAE6OF01EZ6C6.3.19.B08.1.454.CMB.1.raw
  modified_base (194)..(194): a, c, t, g, unknown or other
  misc_feature (194)..(194): n is a, c, g, or t
tcagagacgcactccacgaccggtgctcgatttagtgagtcagtaagggggagccagtctcagtcaggacacagcatggacatggagggtccccgctcagctcctggggctcctgctactctggctccgagatgccagatgtgacacccagatgacccagtctccatccctccctgtctgctatctggtggganacagagtcatcatctcgttgccgggacaagtcagtagttgttaagttatttaatttaaattggttatctagttacaaacgaggaaacgcccctaagcctctagatctatgctgctatcctaagtttaacgaaaggtcgggtccctataccgtaaggttcagtgactagtggatcgtagggactagtactttacactcgtacacctatacctaagttagtacctaacaacgtagtaattatttagaccttaacttactacgttacgtactaactaagtaacgttaaccaaccttaccccctacgtccttacgtaaccggtttccgggacgggaacggtaccgaagggtacgagaacgtaccgaaacgtacgtaggtcgccgtagacctacgtatacgtcttcctgtacc

SEQ ID NO: 70817 - DNA, 593 bp, Homo sapiens
  misc_feature: GYAE6OF01BS1RG.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagtagtgttagttatttaatttaaattggtatctagttacaaaccaggaaacgccctaagctcctgatctatgctgcatcctagtttaacgaaagtcgggtaccagtacgaaggttcagtggcgaggtggatcgtaggactagtatttcactctacacctatctagtagtactaactaacctagtaagtatttagacttaacttactactagtacaactagtacgttaacgacctacccctccgtccttaccgttaccgtttccgggacgggtaccgggaaccgtaaggggtacggaagtaacgtaaccgaaaacgtaacgttacggtcggactacgacctaacctattaccttcgttccgttacttacccg

SEQ ID NO: 70818 - DNA, 543 bp, Homo sapiens
  misc_feature: GYAE6OF01ADLI4.3.19.B08.1.454.CMB.1.raw
  modified_base (268)..(268): a, c, t, g, unknown or other
  misc_feature (268)..(268): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttggccgggcaagtcagagtgttagtatttattaattggtatcagttcaaacagggaaacnccctaagctcctgatctatgctgcatccagtttacaaggtggtccatcaaggttcagtgcagtggatcgtggacagtatttcactctcaccatcagtacgtctacaacctgaagtattttcgacttaactttactactacgtacaactagtacgttacgactacccctccgcttaccacgtttccgggacgggacgggaaccgtaagggtggaaggtactaacgtaaaccggaacttggcggccgtgacctacctacttcctgttccttcgtacc

SEQ ID NO: 70819 - DNA, 670 bp, Homo sapiens
  misc_feature: GYAE6OF01ASVZE.3.19.B08.1.454.CMB.1.raw
  modified_base (270)..(270): a, c, t, g, unknown or other
  misc_feature (270)..(270): n is a, c, g, or t
tcagagacgcactccacgaccggtgctcgatttagtgagtcagtaagggggagccagtctcagtcaggacacagcatgggacatgagggtccccgctcagctcctggggctcctgctactctggctccgagatgccagatgtgacacccagatgacccagtctccatcctccctgtctgcatctggtggagacagagtcatcatctcttgccgggcaagtcagagtgttagtatttattaattggtatcagttacaaaccgagggaaacncccctaagcctaccgtgacttctatcgctgcatcctaagttttaacgaaaggttcggggtaccatacgtaaggttcaggtcggacgtaggtgtactcgtagggaactagtacgtttccaccttcgtaccacctatcgtaacgttagtaccctaactaacccgttagtaacgttacttttaggaccttaaacctttaacgtaaccttgtacctaaacgtaaggtacgtttaaccggtaacctaacccccgttccgtaccgtaccgttaccggtttcgggaaccgggaccgggtaccgtaaaggggtacggtaacggtaacgttaaccggaaaccggttaacgtgggtaggtacccgtacggtcccgaaccgttacgtacttcggttaccttccgttacccg

SEQ ID NO: 70820 - DNA, 612 bp, Homo sapiens
  misc_feature: GYAE6OF01DQDTG.3.19.B08.1.454.CMB.1.raw
  modified_base (191)..(191): a, c, t, g, unknown or other
  misc_feature (191)..(191): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctctgccggnagtcagntgtattatttattaatgtatcattacaacaggaacncctaagctctgatntatgctgacactacctagtttaacgaaggttcgggaccctagtactaaggttcgaggtggcagtgtactgtggactagtatttacactcgtacacctactcaagttacgtactaacctaactagaagttatttcgaactaacttactacgtactactaactagtacgttaacgtaccttaccctacccgtacttacccgttaccggtttaccgggacgggtacgggaacccgtaacggggttaggaacggtaactaaccggtaaaaccgttacggttaggtccgggtactaccggtaacctaaccgttacgttaccgttacgttaccgttcccgttacccg

SEQ ID NO: 70821 - DNA, 741 bp, Homo sapiens
  misc_feature: GYAE6OF01D6U9I.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacaccagatcgaccagtctccactccctcctgtctgctatcgtggtaggaagacgagtacgtacaatctacgttccttcggttcggaccggtacaagtacgaaggtagtttaggtttaatttaattttaaagttttaaagttggtaacttacgtaaacgttaaccgaaaaccggaaacgggtaaacctacccgtaacggtccttcctaggtacttacgttatacggtactacgactaactaccgttaaagtttaaccggaaaagggttccgggtaacctaagttacggtaacggttacgagggttcggacgtagggtacgtacggttacgtagggaactaggtactttaccactactacaactatacgtaacggtactacctaaactaacgtagtaagtttacttaacgaccttaaacttacttacgtagtaacctaacgtaagttaccgtaaccgtacccttacccgtcgtaccgttaccgtacggttacgggaaccgggtaacggtaacggtaaggtaggaaactaacgtaaaccgaaacggttacgtggtacggcctaagaccctacgttactacttacgttcctcgttaaccccg

SEQ ID NO: 70822 - DNA, 825 bp, Homo sapiens
  misc_feature: GYAE6OF01CVGBG.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtctccatcctccctgtctgctagtcgtggtgggagacgagagtctatcattcctcgttcggccgggactaaggtcgaaggtagttaggtttaagtttaattttaaagttttaaagtttgggtaacttaccgtaacggtttaaccgaaaaaccggtaacggggtaaaaccgtacccccgttaaaggccttacccgtaggtaactaccgttagtcgtcgtacgtacctattaccgtaagttttacgaaacggtcgggtaccctagtacgtaaggtttcgagtcggtacgtaggtacggtacgtcggtaggtaacgtacggttaactttccgaaccttccgtaccaacccgtacgtactaacggttactacctaacctaaaccgtagtaacgttagttttacgaacccttaagtttaacctacgtttaacgtaacgtaaacgtacggttaaaccgttaacccgtaacccttaccccgtacccggttacccttacccgttaacccgggtttacgggtaacccggggtaagggtaaacccggtaaagggttaaccgggaacggttaaaccgtaaaccggtaaacgggttaacggttacgggtacggtcccgtaaaccggtacctaaacccgtttattacccgggtttacttcccgttccggttaaccccg

SEQ ID NO: 70823 - DNA, 585 bp, Homo sapiens
  misc_feature: GYAE6OF01AX6P7.3.19.B08.1.454.CMB.1.raw
  modified_base (192)..(192): a, c, t, g, unknown or other
  misc_feature (192)..(192): n is a, c, g, or t
  modified_base (268)..(268): a, c, t, g, unknown or other
  misc_feature (268)..(268): n is a, c, g, or t
tcagagacgcactccacgaccggtgctcgatttagtgagtcagtaagggggagccagtctcagtcaggacacagcatggacatgacgggtccccgctcagctcctggggctcctgctactctggctccgagatgccagatgtgacacccagatgacccagtctccatcctccctgtctgcatctggtggganacagagtcatcatctctgccggcagtcagagtgttagtatttattaattggtatctagttacaaacgtaggaaacnccctaagctcctgatctatgctgctatcctagtttacaaaggtcgggtacccatcgtaaggttcaggtcggacagtggtatcgtagggactagtatttcacttctacactatcaagttacgtactaacaaccttagtaagtattttacgacttaaacttactactgtacctaacgtagtacgttaacgaccttaccccgtacctctaccgttacgtttcgggacggtaacgggtacctacgggtacggaagtaacgtaacgtaaacggtacttaggtcgtacgtacgaccgtaacctattctacgttccttctaccg

SEQ ID NO: 70824 - DNA, 555 bp, Homo sapiens
  misc_feature: GYAE6OF01B9178.3.19.B08.1.454.CMB.1.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (360)..(360): a, c, t, g, unknown or other
  misc_feature (360)..(360): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcttgccgggcaagtcagagtgttagtatttaatttaattggtatnagttcaaacagggaaacncccctaagctcctgtatctatgctgcatcctagtttaacaaaggtcgggtaccctatcaaggttcagtggcagtggatcgtaggacagtntttcactctcacactcagtagtacctacaacctagaagttattttgacctaactttactacttgtactaactagtaacttacgaaccttacccctcgtccttccgtaccgtttcggacggacggaacgtaagggtagacgaataaccgaaacgtaacgtcggtggacctgaccactactcttacgtcttctaccg

SEQ ID NO: 70825 - DNA, 525 bp, Homo sapiens
  misc_feature: GYAE6OF01BNZDK.3.19.B08.1.454.CMB.1.raw
  modified_base (189)..(189): a, c, t, g, unknown or other
  misc_feature (189)..(189): n is a, c, g, or t
  modified_base (418)..(418): a, c, t, g, unknown or other
  misc_feature (418)..(418): n is a, c, g, or t
  modified_base (501)..(501): a, c, t, g, unknown or other
  misc_feature (501)..(501): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgggcaagtcagagtgttagttatttatttaaattggtatcagttcaaaccagggaaagcccctaagctcctgatctatgctgcatccagtttacaaagtgggtccatctaagtcagtggcagtggatctagggacagtatttcactctcaccatctagtacgtctacaacctgaatattttacgctaaacttactaacttgtaccaanagattaacgaactacccctcgcctactacgttcggacggacggaccgaagggtggagtactacgaaaacgtaccttagcgggntcgacactactctgttcttgtaac

SEQ ID NO: 70826 - DNA, 637 bp, Homo sapiens
  misc_feature: GYAE6OF01CYG4T.3.19.B08.1.454.CMB.1.raw
  modified_base (304)..(304): a, c, t, g, unknown or other
  misc_feature (304)..(304): n is a, c, g, or t
  modified_base (377)..(377): a, c, t, g, unknown or other
  misc_feature (377)..(377): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatctatctcgttggccggacaagtcagtagttgttaagttaattttatttaaattggtatctacgttacaaaaccgtagggaaactccctaagcctactgactntatcgctagctatacctaagtttaacgaaggttcgggtacccagtcgtaaggtctaggtgacaggtggatcgngggtaccagttattaccacttcacactagtcgtagtactacctaacgtaaccttaggaaacttgtttacgaccttaaacgttcctaacgtacgtactaacgtaagtaacgttaacctaacccttacccccgcgttactaccgtaacggtttccggaacgggtacggtaaaccgagggttacgacggtaacaacccgtaaaacggtcgttagggacgtaccgtcgaacctaccgtattccgttacgttccttaccgtaccg

SEQ ID NO: 70827 - DNA, 595 bp, Homo sapiens
  misc_feature: GYAE6OF01CO9JR.3.19.B08.1.454.CMB.1.raw
  modified_base (275)..(275): a, c, t, g, unknown or other
  misc_feature (275)..(275): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcgtcggccggacaagtcagtagttgttattattttaattaaattggtatcagttacaaacgaggaaacnccctaagctctgacttctatgctgctactcctaagtttaacaagggttcggtacccagtacgtaaggttcaggtcggacgtaggtggaacttcggaggtactagttacttcgactctacactatctagttactactaactacgtagtaagttatttacgaacttaacttactactagtacctaagtagtacgttaacaccctacccctccgtcttacgtaccggttacgggacgtacggtaaccgagggtacgagtacgtaacgaacgtacgtggtcgcgtaccgacctaccgtacttccgttacttccgttaccgtccg

SEQ ID NO: 70828 - DNA, 644 bp, Homo sapiens
  misc_feature: GYAE6OF01C0A2A.3.19.B08.1.454.CMB.1.raw
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (300)..(301): a, c, t, g, unknown or other
  misc_feature (300)..(301): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtctccactcctccctgtctgcatcgtggtgggagacagagtcatcattctcttgccggctaagcagtagttgttagttaatttatttaaattgtatactagttacaaacgaggaacaccctaagctctnactctatcncnnctactactaagtttaacgaaggtcggtaccatacgtaaggttcgagtcgtacgaggtggacgttcgagggtaactaggttactttaccaccttctaccacttactacgtagttacttacctaactaacgttagtaaacgttactttacgaacttaaacttacttacgtagtactaaacgtacgttaaccgttaccgaacccttacccctaccgtccttaccgttaccggttcgggaaccgggtacgtaaccggaaggtacggaaacgtaacctaaccggaaacggtacgttaggtaccggtacctagacctaccgttagttcctttcgtccgtttcctaaccg

SEQ ID NO: 70829 - DNA, 709 bp, Homo sapiens
  misc_feature: GYAE6OF01BEEZQ.3.19.B08.1.454.CMB.1.raw
  modified_base (222)..(222): a, c, t, g, unknown or other
  misc_feature (222)..(222): n is a, c, g, or t
tcagagacgcactccacgaccggtgctcgatttagtgagtcagtaagggggagccagtctcagtcaggacacagcatggacatgagggtcccgctcagctcctgggctcctgctactctggctccgagatgccagatgtgaccaccagatcgacccagtctccactcctcctgtctgcatctggtgggagacagagtcaatcacttcgtcgttcggccgganagtcgaggtagttagtttagttaattttaagtttaaagttggtactacgtaacgttaaccaaaacggtacggggtaaacctaccccgtaaaggtccttaccgtagtaacttcgtagtcgtcgtacgtaccttaacgtacctttaagttaaacggtaaaccgggttcggtaacctaacgtacggttaaacggttcgaggttcggacgtaggtaggtaccgttaggtacggaacttacgttacgtttacctactacccgtacaacctacttacgtaattaaccgtacgtaactaccgttaagtaacgtttacttacggaaccttaacgttactactaagtactaacgtaacttaaccgtaccgtaaccctaccccgtgtacccgttgtaaccgttcgggaaccgacggtaaccgagggtagaccgtaaagtaccgaaacggtgtacggtacgccgtagaccctacttacgtacttctccgttctacccg

SEQ ID NO: 70830 - DNA, 692 bp, Homo sapiens
  misc_feature: GYAE6OF01C4ZRS.3.19.B08.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (267)..(267): a, c, t, g, unknown or other
  misc_feature (267)..(267): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctctgccgganaagtcagngtgttagttatttattaaagtgtatcagttacaaacgaggaacncctaagctctgactctatgctgactataccgtaagtttaacaaagggtccggtaccaagtacgtaaggttcgaggtcggactaggtacggtactcggagggtactagttactttccaccgttccacctactattacgtacgttacttaacctaacctaaccgttaggtaaactttagttttacgaacctttaaactttaccgttaacgtacgtaacctaaacgtacgttaaccgtttaaccgaacccttacccccgttacgtacccttacgttaacccggtttacggggaaccgggtaacgggtaaaccgtaaggggtacgtaaacgtaccgtaaaccggtaaaaccgtaggttacggtacggtacccgtaacgtaccgtaaacccgttacgtttccgtttaacgttcccgttacgttaaccccg

SEQ ID NO: 70831 - DNA, 679 bp, Homo sapiens
  misc_feature: GYAE6OF01A8FAF.3.19.B08.1.454.CMB.1.raw
  modified_base (161)..(161): a, c, t, g, unknown or other
  misc_feature (161)..(161): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (360)..(360): a, c, t, g, unknown or other
  misc_feature (360)..(360): n is a, c, g, or t
tcagagacgcactccacgaccggtgctcgatttagtgagtcagtaagggggagccagtctcagtcaggacacagcatggacatgagggtccccgctcagctcctgggctcctgctactctggctccgagatgccagatgtgacacccagatgacccagtcnccatccctcctgtcctgcatctgtgganacngatcatcatctcttcggccggacaagtcagtagtgttagttatttatttaaagttggtatctacgtacaaaccgagggaaactccccgtaagtcctcgtagacttcgtatcgactgactatacctaagtttacgaaacggtcggtacccagtcgtaaggttcagtggnaggtgatcgaggacctagtactttacaccgttctaccgtaacctagttaccgtaacgtacgttacctaaacccgaacgttaagtaaacgttattttaccgaacctttaacgttaaccttaaccgtacgttaaccaacgtaacgttaacgttaaccgtaacccttaccccgtaccgtacgttaccgttaccggtttaccgggaacggggtaccgggttaaccgaacgggtaggtaaacccgtattaacccgaaaacgttacccggtagtcccggtacgtaccgactaaacccggtcttagttccgttccttaccgtaccg

SEQ ID NO: 70832 - DNA, 799 bp, Homo sapiens
  misc_feature: GYAE6OF01EEYFQ.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtctccatccctccctgtctgctatctggtgggagacagagtcatcatctcgttcggcccgggactaagtcaggtagttaggtttaagtttaatttttaatttaaagtttggttaattacgtaagttaaccaaaaaccggtaaggggaaaacctacccccgttaaaggtccctttacctaggtacttaccgttaagttccggtacgtcggtacctaacgttaacccgttaaaggttttaaaaccggaaaacggggtttcccgggggttaaccccctaaggttaaccggttaaacggggtttaccgtaaggggttcggggtaaccgtagggttacgggtacgttaccgggtagggggtaactaacggttacttttaccgaccttacctaccgtaacctagtaccgtacgttaacgtccttaaaccgtacgtagtaacgttatttacgaaccttaactttacgttaccttagaacctaacgtaaggtaaccgtttaaccaccgttacccctccgtaccttacgtaccgggtttccgggacggtaacgggtaaccgaagggttacggaacgtaacgtaaccggaaacgtaggttcggtacggaccgtacgacctaccgtacgtccttcgttactctaccccg

SEQ ID NO: 70833 - DNA, 630 bp, Homo sapiens
  misc_feature: GYAE6OF01BOQLG.3.19.B08.1.454.CMB.1.raw
  modified_base (283)..(283): a, c, t, g, unknown or other
  misc_feature (283)..(283): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccactcctccctgtctgcatctggtgggagacagagtcatcatctcgttcgccgggcaagtcagtagtgttagttatttaatttaaattggtatctaagttaccaaaaccgaggggaaacnccccgtaagcctcctagtactctatgctgctactccgtaagtttaaccgaaagggttccgggtacccctaagttaccgtaacggttcgaggttcggactaggtgtaccgttcggtacgggactagttactttccaccttcctaccgacctagtacgtagttacgtactaaccgtaactagtaagttatttacgacttaacttactacgtacgtacaagtacgtacgttaacgacccttaccccgtctaccttaccgtcgtttaccgggacggacggtaaccgaggtagaacgtagtacgtaaagtcgaagttcgagtaccgacgtactacgtattctagttctaccg

SEQ ID NO: 70834 - DNA, 801 bp, Homo sapiens
  misc_feature: GYAE6OF01DC6YO.3.19.B08.1.454.CMB.1.raw
  modified_base (204)..(204): a, c, t, g, unknown or other
  misc_feature (204)..(204): n is a, c, g, or t
  modified_base (791)..(791): a, c, t, g, unknown or other
  misc_feature (791)..(791): n is a, c, g, or t
tcagagacgcactccacgaccggtgctcgatttagtgagtcagtaagggggagccagtctcagtcaggacacagcatggacatggagggtcccccgctcagcctccgtggggctcctgctactctggctccgagatgccagatgtcgaccacccagactcgacccagtcctccactccctccctgtctgctagtctggtggganacagtaatcatcgacttctcgttcggccgggacaagtcgagtagttgttaagtttaatttaacttttaaagtggtattacgtaagttaaccgaaaccgaacgggtaacccgtaccctaagtccgttcctagtaaccttacgtacgtcgtctacgtactacgttaccgttaaggttaaccgtaaacgggttccgggaaccctaagttacgtaggttacgagggttacggactaggttacggacttacgggtacggtaaacgttacgtttacttacctacgttccctaaccgttaaactcgttaaccgtaaggttacctaaccgttaaacgtaaaccgtttaagtaaacgttttacgtttacccgtaaacctttaaaccgttacccgttaaacttcggtaaccctaaaaagggttccgtaaaccggttttaaacccacccccttaaccccgttcccggttaacgtcccgtttaaaccgggttcgggaaccgggtaaccggtaacggtaacgacgggtactaaaccgaaccggttaaggaccgttaggtccgtagtacccgtaaaccgtactacgttccgttccgtttanccgtaacccc

SEQ ID NO: 70835 - DNA, 732 bp, Homo sapiens
  misc_feature: GYAE6OF01DW7OP.3.19.B08.1.454.CMB.1.raw
  modified_base (197)..(197): a, c, t, g, unknown or other
  misc_feature (197)..(197): n is a, c, g, or t
tcagagacgcactccacgaccggtgctcgatttagtgagtcagtaagggggagccagtctcagtcaggacacagcatggacatgacgggtccccgctcagctccgtggggctcctgctactctggctccgagatgccagatgtgaccacccagatcgacccagtctccatccctccctgtctgctatctggtggganacagagtcatcatctcgtcggccggactaagtcaggtaggttagtttaagtttaattttaaagttttaaaagttggttaactaccgttaacgtttaacccgaaaaaccggtaacggggaaacctacccccgtaaagtccttacccgtagtacttacgttatcgctacgactacgttaccgttaagtttaacgaaacggttccgggtacctaacgttacgtaacggttacgaggtcggacgtaggtggtacgtcggtaggaactagttactttacgaccttcctactaacagtacgtagttacgtactaactaacgttaagtaagttatttacgaccttaactttacctagtacgtaacaacgtagtaaccgttaccgtaacccttaccccgtccgtaccttaccgttaccggtttccgggaccgggtacggtaaccggtaaggtacgtaacgtaaacgtaccgtaaaccggtacgttacggtccggaccgttacgaccccttacgtacttccgttacgttccttacccgtacccg

SEQ ID NO: 70836 - DNA, 769 bp, Homo sapiens
  misc_feature: GYAE6OF01DAF1E.3.19.B08.1.454.CMB.1.raw
  modified_base (739)..(739): a, c, t, g, unknown or other
  misc_feature (739)..(739): n is a, c, g, or t
  modified_base (752)..(752): a, c, t, g, unknown or other
  misc_feature (752)..(752): n is a, c, g, or t
tcagagacgcactccacgaccggtgctcgatttagtgagtcagtaagggggagccagtctcagtcaggacacagcatggacatgacgggtccccgctcagctccgtggggctcctgctactctggctccgagatgccagatgtgaccacccagatcgacccagtcctccatccctccctgtctgcattcgtggtgggagacagagtcatcattctcgtcggccggacaagtcgaggtagttagtttaagttaattttaagtttaaagttggtaactactaagttaaccaaaacggaagggtaaacctccccctaaaggtccttaccgtagtaacttccttaagtcgtcccgtagtacctaacgttacccgttaaaggttttaaaaccgtaaaacggggttcccggggtacccctaaagtttaaccggtaaaacggggttttcgaaacggggttaggggaccgttaaagggttcgggtaaacgtttccgggtaacggggtaactaaaggtttaccgttttacccaaccttactacccgtaaacctagttacccgttaagttaccgtaacttaacccgtaaacgttaggtaaactttacgttttacgaacctttaaacgtttaacttaacgtacgtaacaaacgtacgttaacgttaacctacctaccccgtctccgttacgtaccggttcgggacggaacggtaacgaaggtggaacaacgtaacgaacgtacgtggtcncgtagacctactntacctgttcctcgtacc

SEQ ID NO: 70837 - DNA, 586 bp, Homo sapiens
  misc_feature: GYAE6OF01BAFP7.3.19.B08.1.454.CMB.1.raw
  modified_base (268)..(268): a, c, t, g, unknown or other
  misc_feature (268)..(268): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttatatttattaaattggtatcagttacaaaccagggaaacncccctaagctcctgatctatgctgcactcctaagtttaacaaaggtcgggtacccatactaaggttcacgtggcaggtgatcgtggacagtatttcactctacacatcgaagtacgtactaacaaccctagtaacgtattttcgacttaaactttacgtacttagtactaacgtaacgtaacgtttaacacttacccccgttcgaccttcgtaccgtttcggaccgggtaggaaccgaagggtcggtaacgactaacgaaaaccgtaagtacgggtcgtaccgtgacccgacctattacctcggttccttacgtaccg

SEQ ID NO: 70838 - DNA, 728 bp, Homo sapiens
  misc_feature: GYAE6OF01E464D.3.19.B08.1.454.CMB.1.raw
  modified_base (196)..(196): a, c, t, g, unknown or other
  misc_feature (196)..(196): n is a, c, g, or t
  modified_base (292)..(292): a, c, t, g, unknown or other
  misc_feature (292)..(292): n is a, c, g, or t
  modified_base (633)..(633): a, c, t, g, unknown or other
  misc_feature (633)..(633): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatcgacccagtctccatccctccctgtctgcatcgtggtaggganacagagtcaatcattctcgttggccgggtacaagtcaggtagttgtttaagttattaatttaaagttggtatacgtagttacaaaccgaggaaacncccctaagcctcctgatactatgctagactactacctaagtttaacaaaggtcgggtaccattacgaacggttctaaggtgacgtaggtggtactcgtacgggacaagttactttaccgaacttccgtactaaccctagtctaacggttactaacctaaaccgtaaacccgttaggtaaacggtttacttttacggaacctttaaaccgtttacgtaaccgtttacgtaaccctaaacgtacggtaaaccgtttaaccgacccgttaaccccccgtcccggtaccttacccgttaaccggtttcccgggaaccggggtaaccgggaaccttaaacgggggngtaaaaccggttaaccgtaaacgaaacccggttaacggtcggtaccggtacgtaccgtacctaaccgtacttacgttcttacgttaccgtacccg

SEQ ID NO: 70839 - DNA, 594 bp, Homo sapiens
  misc_feature: GYAE6OF01BYG4Y.3.19.B08.1.454.CMB.1.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (269)..(269): a, c, t, g, unknown or other
  misc_feature (269)..(269): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnaagtcagagttgttagtatttatttaaattggtatctagttacaaacgagggaacncccctaagcctcctgactctatgtctgctacgtcctaagtttaacgaaaggttcgggtacccagtacgtaaggttcaggtcgcgtaaggtggaactcgtaggactagtactttcgacttcctacacctactacgtagtacgtctaacgaacctagtaacgttatttacgaccttaactttacctactagtaccaagtagtaacgttacgacctaccccgtcgtactaccgtacgttcggacggtacggaccgtagggtagacgtacgtacgaaacgtagtcggtcgactcgacctaaccgtacttccgtcgttcttcgttacccg

SEQ ID NO: 70840 - DNA, 664 bp, Homo sapiens
  misc_feature: GYAE6OF01C6MSK.3.19.B08.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
  modified_base (641)..(641): a, c, t, g, unknown or other
  misc_feature (641)..(641): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtcctccactcctccctgtctgcatctggtggganacagagtcatcatctcgtcgccggnaagtcagagttgtaattatttattaattgtatctagttacaaacgtaggaaacnccctaagtcctctagacttctagtcgctagcctacttaccgttaaagtttaacgaaacgggttccgggtaacccctagttacgtaaaccggtttcgaaggttcgacgtaggttggaacggtttcggcgggaactaggtttacttcctaacctcaccgtactagtaccgtagtaacttacaactaaccgttagtaattactttcgaacttaacttactacgtacgtaacaacgtagtaaccgttaccgaacccttaccccgtaccgtactaccgttacggttaccgggacgggtaccggtaacgtaacgggtaggaaacgtacaaccggtaaacgtacggtacggtcggaccttacggacctaccttanccgtttacgtactttcctacccg

SEQ ID NO: 70841 - DNA, 743 bp, Homo sapiens
  misc_feature: GYAE6OF01D2V2W.3.19.B08.1.454.CMB.1.raw
tcagagacgcactccacgaccggtgctcgatttagtgagtcagtaagggggagccagtctcagtcaggacacagcatggacatgacgggtccccgctcagctccgtggggctcctgctactctggctccgagatgccagatgtcgaccacccagactcgacccagtcctccactccctccgtgtctcgctatcgtggtgggacgactaggactctatctacttcgttcgttacgggaccgggtacaaggtcgaaggtaagttagttacgacgttaaggtttaatttaagttggtataacgaataaaccgaaaaacggtaacgggtaaaccttaccccttaaaagttttcgaacttacctaagttcgacgtcacctacgtaccgtagttaccgacggtaacggtcggtacctaagtacgtaagtacagtcggacgtagacggtgtacgtacggtaattacgttacttaccaccttaccgtaaccactacgtacgtaacgtaccgtacggttaccaacggtcgttaacgtaggttaatttaccgtttacaaacgtttaaccttaacgtaacttacgaacctaaagttacgttaacgttaacctacggttttagttaccttttacgtaccgtttccgggtacccggttaccggaaaggtaccgttaaagaccggtaactaacgttaaccgaacggttcggtacggtccgtaacgttacccgacttaagtcttccgtcgtttacccg

SEQ ID NO: 70842 - DNA, 696 bp, Homo sapiens
  misc_feature: GYAE6OF01BFJAF.3.19.B08.1.454.CMB.1.raw
  modified_base (283)..(283): a, c, t, g, unknown or other
  misc_feature (283)..(283): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtcctccactccctccctgtctgcatctggtgggagacagatcatctatctcgtggccggcaagtcaggtagttgttaagttattttaattaaattggtatctagttacaaacgacggaaacnccctaagcctactgactctatgtctgctactcctagttaacgaaggttcgggtaccctagtacgtaaggttcgaaggtcggacgtaaggtcggtacgttcggtagggaacctaaggttacttttacgaccgttacctacctaaccgtactaccgtaacgttaacgttacctaaaccgtaaccgtaagtaaagtttacgtttacgaaccttaaacttaccttaacttacgtaacctaaacgtaacgtaagtttaacctacccttaccccgtacccgtaccgttaccgttaccggtttaccgggaccgggtacgggtaaccgtaagggtacggaacgtaacgtaaccgtaaacggtacgttagggtcgtaccgtcggaactacccgtacttacggttccttccgttactaccccg

SEQ ID NO: 70843 - DNA, 628 bp, Homo sapiens
  misc_feature: GYAE6OF01DJYYK.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtctccatccctccctgtctgcatctggtgggagacagagtcatcatctcgtcggccggacaagtcagtagttgttaagttaattttaagtttaaagttggtaatacgtaacgtttaaccaaaaccggaaggggaaacctacccctaagccttccgtagtacttctagtcgctgcctactaccgtaagtttaacgaagggtcggtaccctagtacgtaaggttcaggtgacgtaggtgacgtcgaggactagtacttcactcacacatcagtactactactaactgtaattacttcgactaacttactacgtagtaacaacgagttaacgttacgacccttaccccgtcgtccttaccgttacggttccgggacggtacgggtaacgaagggtaggaactaacgtaaccgaaaacgtacgtgggtcgaccgtagacccgtactattacccgttgttccttcgtaacccg

SEQ ID NO: 70844 - DNA, 750 bp, Homo sapiens
  misc_feature: GYAE6OF01E1SI9.3.19.B08.1.454.CMB.1.raw
  modified_base (273)..(273): a, c, t, g, unknown or other
  misc_feature (273)..(273): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctctggccggcagtcagagttgttagttatttaatttaagttgtatcgtagttacaaacgaggaaacnccctaagcctacctagatactagtcgctgaccactaccgttaagtttaaaccgaaaggttccggggtacccctagtaccgtaacgggttacgaggttacggacgtaggtacggacgttaccggtaggggaactaacgttacgttttaccgaccttaccgtaccaacctacgtaccgtaacgttacgttaacccgttaaacctaacccgttaaggtaagtttattttacgaacccttaaactttaaccgtaccttacgtacccgaaacgtaacggtaaccgttaaccgtaccccgttaaccccctacccggtaccttacccggttaaccgtttccggggaacggtaaccgggggtaaccgtaaggggttaccggtaacgtaacggttaaaccgtaaaccggttaacggttacggttaccggtaccgtacgacccgtaaaccgttacgtttacccgtcggtttaccttccgttaccccg

SEQ ID NO: 70845 - DNA, 578 bp, Homo sapiens
  misc_feature: GYAE6OF01BFOLT.3.19.B08.1.454.CMB.1.raw
  modified_base (193)..(193): a, c, t, g, unknown or other
  misc_feature (193)..(193): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtctccatccctccctgtctgcatctggtggganacagagtcatcatctcttcgccggacaagtcagagttgttagtattttaattaattgtatcagttacaaacgaggaacgaccctaagctcctagactctatgctgctatcctagttaacaaggtcggtacctagtactaggtcgagtggtcaggtgtactggtaggactagtatttcgactctaccactactctagtacgtactaactaacgtagtaagtacttagaactaactttaactaccgtatactaactagtaacgttaactaccgttacctacccgtctaccgtaccgtttcggaccggtacgaccggtaggacggtacaacgtacgtaaacgtacgtaggtcgtacgtacgacctactacgtagtcttccttctaccg

SEQ ID NO: 70846 - DNA, 846 bp, Homo sapiens
  misc_feature: GYAE6OF01EV8GX.3.19.B08.1.454.CMB.1.raw
  modified_base (392)..(392): a, c, t, g, unknown or other
  misc_feature (392)..(392): n is a, c, g, or t
  modified_base (825)..(825): a, c, t, g, unknown or other
  misc_feature (825)..(825): n is a, c, g, or t
tcagagacgcactccacgaccggtgctcgatttagtgagtcagtaagggggagccagtctcagtcaggacacgagcatggacatgagggtccccgctcagctcctggggtctcctgctactcgtggctccgagatcggccaggatgtgacacccgagatcgacctagtctccatccctccctgtctcgcagtcgtaggtacgggacgacaggtagtacctatccgtaattccgttacgttacggacccgggtaattaacggtccgtaaggtacgtttagtttaaagttaattttaaagtttaaacgttggtacttacgtaacgttaaccaaaacggtaacggggaaacctcccgtaaagtcccgttacgtacgtaactttcgtaacgtcgtnttacggaccttaccgtacgtttaaacgggttaaccgttaaacgggttaccgggtacccctaagtttaacggtaaccggtttcgaaggtacgggtctaacgggttacggtaacgttcggtaacgggaacttaacgttaccgtttaccacggtttacccaccaaccttacgtacgttaacgggttacctaacgttaaaccgtaaacggttagtaaacgtttatttaacccggtaactttaaacctaccgttaacgttaaggaacctaaacgtttacggtaacgtaaccctttaacccgttaacccccgtccgtttaacgtaccgtttaaacccggggttccgggaacgggtaaccggggtaaccgaaggggtttaccaaaggttaaccctaaacggtaaaccgtacggtagtccgggactaacgtactaaccgtntaccgtcgttactcgtaaccg

SEQ ID NO: 70847 - DNA, 842 bp, Homo sapiens
  misc_feature: GYAE6OF01EGGW3.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtctccatccctccctgtctgcatctggtgggagacagagtcatcctatccttcgttcggcccgggacaagtcgaaggtagttaggtttaagtttaattttaagttttaaaagtttgggttaacttacgtaacgtttaaccaaaaaccggtaaacggggaaaaccgtacccccgtaaaggtcccctttacccgtaggtaacttacttaagttcggtcgttcgacctaacgttacccgttaaaggtttaaacgtaaacgggttccgggggtaacccctaacgttaaccggtaacgggtttacgtaagggttcgggacgtaagggttacggtaacggttacgggtacggggaaacttagggtttaaccttttaccgtaccttccgtaaccctaacctaactttacgtaacggttaaccgttaaccttaaacccgtaaccgttaaggtaaacgttttacttttaaccgaacctttaaacctttacccgttaacgttaacgtaaccctaaacgtaaccggttaaccggttaaccctacccctttaacccccgtcccgtaccttaccgttacggttccgggaccggggtaacggtaaccgagggtacgaacggtaaccgtaacggtaaacgtacgttgggccgtacgtaccgacccgtacttacctcgttacgttcctcgttacccg

SEQ ID NO: 70848 - DNA, 662 bp, Homo sapiens
  misc_feature: GYAE6OF01AUXPC.3.19.B08.1.454.CMB.1.raw
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (595)..(595): a, c, t, g, unknown or other
  misc_feature (595)..(595): n is a, c, g, or t
tcagagacgcactccacgaccggtgctcgatttagtgagtcagtaagggggagccagtctcagtcaggacacagcatggacatgacgggtccccgctcagctcctggggctcctgctactctggctccgagatgccagatgtgaccacccagatcgacccagtcctccatccctccctgtcctgctatcgtggtgggagacagagtcatcatctcgttcggccgggcaagtcgagtagttgtttagttattttaattaagttgtatctagtacaacgaggaacnccctanctactgtactctatgctgtactactccgttaagttaacgtaaggtccggtacctagtaccgtaaggttcgaggtaggtacgtaggtaggtacgtacgtaggacgtagttacgtttaccaccttaccgtctaaccgtataccgtagttacctacctaaccgtaacgtagtaagttactttacgaacccttaacgtttaccgtaccgttataccgtaacgtaggtaaccgttacccctacgtaacccccgttccctactttaccggtaccgttcgggaccgggtacgggtaacgtagggtacggtanaaccgtaacgaaacggtacgtggtcggaccgtcgacctacgttacgtccttcgtaccttcggtaccc

SEQ ID NO: 70849 - DNA, 716 bp, Homo sapiens
  misc_feature: GYAE6OF01AL92V.3.19.B08.1.454.CMB.1.raw
  modified_base (193)..(193): a, c, t, g, unknown or other
  misc_feature (193)..(193): n is a, c, g, or t
  modified_base (257)..(257): a, c, t, g, unknown or other
  misc_feature (257)..(257): n is a, c, g, or t
tcagagacgcactccacgaccggtgctcgatttagtgagtcagtaagggggagccagtctcagtcaggacacagcatggacatgagggtccccgctcagctcctggggctcctgctactctggttccgagatgccagatgtgacacccagatgacccagtcctccatccctccctgtctgcatctggtggganacgagagtcatcatctctcggccggacaagtcagtagtagttagttatttaattaaatggtatnagttacaaacgaggaacgtccctaagctacctgacttactatcgtctgactacttacccgtaagtttaacgaaaggttccgggtaccctaagtacgtaaggttcgaggtaggacgtaggtaggtacgtcggtacgggtaactaagttactttaccgacttccgtacctaacccgtattaccgtaacgttaacgtacctaaaccgtaaccgttaaggtaaactttacgttttacgaaccttaaactttaaccgtacttacgtacctaaacgtaagtaacgtttaacccgtaaccgttacccccgtacctccgtaaccgttaccgggttaccggggaacggtaacgggtaacccgtaagggtcggtaaacgtaaccgtaaaccggtaaaaccggtacgtgggtaccgtacgtacggaaccctaccgttaacttcgttacttcccgttctcccgttaccccg

SEQ ID NO: 70850 - DNA, 687 bp, Homo sapiens
  misc_feature: GYAE6OF01B5UJ6.3.19.B08.1.454.CMB.1.raw
  modified_base (647)..(647): a, c, t, g, unknown or other
  misc_feature (647)..(647): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtcctccactccctccctgtctgctatcgtggtgggagacagagtcatcactctcgttcggccgggacaagtcgagtagttagttaagttattttaatttaaagttggtatacgtaagttaacaaaccgaagggaaaccgtcccctaagtcctaccgtagtacttactagtcgtctcgacgtactaccgttaagtttaaacgaacgggttccgggtaccctaagtacgtaaggttcgaggtgacgtaggtcgtacgtggtaggactagttacttactacctctaccactatacgtagttactacctaactaacgtaagtaacttagtttacgaccttaaacttacttacgtacgtaactaaacgtagttaaccgtttaccaacccgttacccccgtcgtaccttacccgttacggttacgggaacggggtacgtaaccggtaagggtaacgaacgtaaccgtaccgtaaaccggtatagggttccgngtacccggaactaccgtattccttcgttaccttcgtaccc

SEQ ID NO: 70851 - DNA, 772 bp, Homo sapiens
  misc_feature: GYAE6OF01BNG43.3.19.B08.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgtcagatgtgacacccagatgacccagtctccatccctccctgtctgctatcgtggtaggganacagagtcatcatctcgtgccggganaagtgagtagttgttaattatttaatttaagttggtatatacgttaacaaacgaaggaacgtacccgtaacgctcgtagtacttactaagtgcttgacctactaccgtaagtttaacgtaaggttacggggttacccaagttacgtaaaggttacgaacggtacgggagtaacggtagtacggttaccgtagggtaacgtaacggttactttacctaaccgttactaaccacctaattcgtaaacgttacgtaaccttaaactaacccgttaagaaggtttactttacgtaaccgttaaactttaaccgtacgttacgaacgttaaaccgtaacgttaacgttaacggtaccccttaacccccgttaccgactttaacccgtaccgggtttaaccgggacccgggtaagggtaaacccgggttaagggtaaacggtaaccggtaacgtaaaccgggtaaaacggtaacccgggttaggttaccggacccggtaaacgtaccccggtaaacctttacttaccggtttaccttcccgtttacccggtaaaccc

SEQ ID NO: 70852 - DNA, 711 bp, Homo sapiens
  misc_feature: GYAE6OF01CB2YX.3.19.B08.1.454.CMB.1.raw
  modified_base (281)..(281): a, c, t, g, unknown or other
  misc_feature (281)..(281): n is a, c, g, or t
  modified_base (461)..(461): a, c, t, g, unknown or other
  misc_feature (461)..(461): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtggagacagagtcatcatctcttcggccgggacaagtcagtagttgttagttattttaattaaagttggtatctagttaccaaacgtagggaaacncccctaagcctctagatctatgctgcatccgtaagtttaacgaaggttcgggtacccaagttacgtaaacgggtttcaaggtcggactaaggtggtacgttcggtaggggaacctagttaactttcacttcgtaccactactcgtaacgttacgtacctaaaccgtacgtaagtaacttntttacgacctttaaacgtttacctacgttacgacctaaacgtacgttaaaccgttaccgtaacccttaccccgtcccgtaccttacccgttaacggttttcccgggggaaccgggtaacgggtaacccggttaaaggggtacggtaaacgtaaaccgttaaccggaaaaaccggttcggttacggtccgggtactacccgggaacctaacccgttagttcccgttaccggttccttcccgttaaccccgg

SEQ ID NO: 70853 - DNA, 626 bp, Homo sapiens
  misc_feature: GYAE6OF01BWIK6.3.19.B08.1.454.CMB.1.raw
  modified_base (228)..(228): a, c, t, g, unknown or other
  misc_feature (228)..(228): n is a, c, g, or t
  modified_base (589)..(589): a, c, t, g, unknown or other
  misc_feature (589)..(589): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtcctccactccctccctgtctgcattcgtggtgggagacgagacgtcatcattctcgttcggccgganaagtcagtgttagttagttaatttaatttaagttgtatctagtacgaaacgaggaacacccgtagctcgtagtactcgtatcgtctcgactactacctaagtttaacgaacggttcggacctagtacgaaggttcaggtcgagtgtagtacgtcggtaggacagttacttactacttctactaccgtagtctaagttaaccgtactaaactaacgttagtaagttatttaccgaacttaaacttaccgtacttaacgtaactaacgttaaggtaaccgttaaccgtaccctaccccgtacttaccgtaccgtacggttcggaccgggacggaccgttagggagtactaacgtacgaaagtntacggtgctacgactactacttgtcttcgtcttaccg

SEQ ID NO: 70854 - DNA, 701 bp, Homo sapiens
  misc_feature: GYAE6OF01A493N.3.19.B08.1.454.CMB.1.raw
  modified_base (672)..(672): a, c, t, g, unknown or other
  misc_feature (672)..(672): n is a, c, g, or t
  modified_base (683)..(683): a, c, t, g, unknown or other
  misc_feature (683)..(683): n is a, c, g, or t
tcagagacgcactccacgaccggtgctcgatttagtgagtcagtaagggggagccagtctcagtcaggacacagcagtggacatgagggtccccgctcagctcctgggctcctgctactctggctccgagtatgccagtatgtcgaccaccctagactcgacccagtctccatccctcctgtctgcatcgtggtaggacactagtagctagtcatcctcgtcgggcccggataacggtctaaggtgttagtttacgtttaattttaaagttttaaacgttgttataccgtaacgtttaaccgaaaaccggtaacggggtaaaacctacccccgtaaagtccgttacccgtaacgtaacttacgttaacgtcgtcgtaacgtacgttaccgtacgttaaacggtttaacggaacggttcccgtaccgtatacggttaaacgtcgaggtacggtactaaggtcggtacgttacgtacgggtaactaagttacgtttacactacgtaccgtaacgtactacgtagtaacgtactaaccgtaactacgtaagttacgttacgtaacttaacgttactaacgtactaacgaactagtaacgtactaccctaccctcgacttacgtaccgttcggacgaagtacgacggtagtacacgtaacgaacgtagagtccggntacggactacncgttatcgtcgtgtaccg

SEQ ID NO: 70855 - DNA, 633 bp, Homo sapiens
  misc_feature: GYAE6OF01CN0QG.3.19.B08.1.454.CMB.1.raw
  modified_base (233)..(233): a, c, t, g, unknown or other
  misc_feature (233)..(233): n is a, c, g, or t
tcagagacgcactccacgaccggtgctcgatttagtgagtcagtaagggggagccagtctcagtcaggacacagcatggacatggagggtccccgctcagctcctggggctcctgctactctggctccgagatgccagatgtgaccacccagatcgacccagtcctccactccctccctgtctgctatctggtagggacgacagacgtctaatcattctcgttcggccggganaagtcagtgttagttattattttaattaaagttggtatactagttaaccaaacgaagggaaaccgtacccctaagcctctagacttctatgctgacctactaccgttaagttaacgaaacggtcgggtacctagtacgtaagtcgaggtcgacgagtggtatcggtggtacagtacttcactcacactactcgtagtactactaacctaactagtaagttacttcaactaacctttactactctaacctaaagtacggttaacgttaccgtaacccttaccccgtcgtaccttacgttaccggtttaccgggacgggtacggtaacgtagggtacgaagtacgaaacgtaacgtaacggttggtcgactccgacctactagtcctacgttctacctaccg

SEQ ID NO: 70856 - DNA, 687 bp, Homo sapiens
  misc_feature: GYAE6OF01BGOP2.3.19.B08.1.454.CMB.1.raw
  modified_base (218)..(218): a, c, t, g, unknown or other
  misc_feature (218)..(218): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatgacccagtcctccatccctccctgtctgcatctgtgggagacagagtcatcatctctggccgganagtcagagttgttagtatttatttaattggtatcagttacaaaccgagggaaacgccccctaagcctcctagtactactatcgactgactactcctaagtttacgaaaggttcgggtacccagtacgtaacggttacgaggttggacgtacggtggtacgttcggtaggggtactagtactttacgaccgttcctaccacctactacgtaagttacgtaacctaacctaaaccgtaggttaacgttacgttttacggaacccttaaacctttaaccgttaacgttacgtaacctaacgtaagttaaccgttaaccgtacccttacccccgtacccgtccttaccgttaccggtttacggaccgggaaccgggtaccgtaagggtcggtaagtacgtaaaccgaaacggtaacgtaggttcggaccgttacgaccctactaccgtacgttccggttccttccgttacccg

SEQ ID NO: 70857 - DNA, 730 bp, Homo sapiens
  misc_feature: GYAE6OF01BU7CF.3.19.B08.1.454.CMB.1.raw
  modified_base (197)..(197): a, c, t, g, unknown or other
  misc_feature (197)..(197): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtctccatccctccctgtctgctatcgtggtgggaanacagtagtcatctatcttcgttcggccggacaagtcgaggtagttagtttaagtttaattttaagtttaaaagttcggtacttacgtaacgttaaccaaaaccggtaagggaaacctcccctaaagtcctacctagtaacttctagtgactcgactaagtaccgtaagtttaacgaaggtccgggtacctaagtacgtaaggttcaggtacgagtaggtagtacgtcggtacggtaactacgttactttcaccgttcacctaactacgtacgtaacgttaccaaccgttaaacaaccgttaataacgtttaactttacgaaccgtttaacttaaccgttgttaacgtaaccctaaaggttaactaaccgtttaccgtaacccgttaccccgtcccgacgttacccggttaacggttccgggaacggtaccggtaacggtacgggtagtaccgaaacgttaaccggaaacgtaggttcggaccgtacgtacccgtaacgttccaacgtttccgttcttaccgtccttaacccgg

SEQ ID NO: 70858 - DNA, 668 bp, Homo sapiens
  misc_feature: GYAE6OF01BXL5T.3.19.B08.1.454.CMB.1.raw
  modified_base (266)..(266): a, c, t, g, unknown or other
  misc_feature (266)..(266): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctcctgtctgcatctggtgggagacagagtcatcatctcttgccggcaagtcagagtgttagtatttattaattggtatcagttcaaacgagggaaacnccccgttaagccttacctagactctatcgctgctataccgtatttacgaaaggttcgggtaccctagtaccgtaaggttcgaaggttcggacgtaggtggtaactcggtacgggaactaggtactttccgacttctaccgacctagtctaagttactactaacacgtagaacgtttatttacgaccttaaactttaccgtacgttacgtactaaacgtaggttaacgttaccgaaccctttacccccgtaccggtaccttaccgtaccggtttaccggggaccgggtaaccgggtaaccgtaaggggtcggtaaacgtaccgtaacgaaaccggttaacgtgggttacggaccgtggaacccctaacgttacgttaccttcggttacccttccgttaacccg

SEQ ID NO: 70859 - DNA, 611 bp, Homo sapiens
  misc_feature: GYAE6OF01C2VF2.3.19.B08.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
tcagagacgcactccacgaccggtgctcgatttagtgagtcagtaagggggagccagtctcagtcaggacacagcatggacatgagggtcccccgctcagctcctggggctcctgctactctggctccgagatgccagatgtcgaccacccagatcgacccagtcctccactccctccctgtctgctatcgtggtggganacagagtcatcattctcgtcggccggacaagtcgagtagttgttagttaattttattaagttgtatctagttacaaacgaggaaccncctagcctctgactntangctgctatcctaagttacgaaggtcggacctagtacgtacgtnaggtgactggtacgtntcggaggtactgttactccactccacactatacgtatactactaacactagtaacttattcaccttaacgttctacactaacgaactacgttaacctacctaccttacccccgtctacgttccgttaaccgggttccgggaacgggtacggtaaccggtaaggtaaccgacgtaaccgtaaacggaacggtcgttacggccgtactacgacccttacgtacttccggttactcccttcgtaaccccg

SEQ ID NO: 70860 - DNA, 614 bp, Homo sapiens
  misc_feature: GYAE6OF01C1ZFJ.3.19.B08.1.454.CMB.1.raw
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtcctccactcctccctgtctgcatctggtggganacagagtcatcattctcgttgccgggnaagtcagagttgttagtattttattaaattggtatacagttacaaacgaggaaactaccctaagcctctgtatctatgctgctactcctaagtttacaaaggtcgggtaccatagtaagtcaggtggacaggtgtatcgtggactagtattaccacgtactccacctagtactacgtaacgtacctaacgaaccgtagtaaattacttttgacccttaacgttaccttacgtagtacctaaagtacgtaacgttaaccgaaccctttacccccgtacgttcctacgtaccggtttacgggaccggtacgggtacgtaaacgggtcgaaacgtactaacggaacgtacgttcggtaggactacgtctaccgtatccttcgtccttcgtaacccg

SEQ ID NO: 70861 - DNA, 501 bp, Homo sapiens
  misc_feature: GYAE6OF01BSIKJ.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaagccctaagctcctgatctatgctgcatccagtttacaaagtgggtccatcaaggttcagtggcagtggatcgtggacagatttcactctcacatcagtagtctacaactgaagtattttgactaacttactactgtacaacagtagttacgactacccctccgctactacgtttcggacggacggaccaaggtgagatacaaacgactggtggactgaccactatctcgtctctac

SEQ ID NO: 70862 - DNA, 738 bp, Homo sapiens
  misc_feature: GYAE6OF01B0OQN.3.19.B08.1.454.CMB.1.raw
tcagagacgcactccacgaccggtgctcgatttagtgagtcagtaagggggagccagtctcagtcaggacacagcatggacatgagggtccccgctcagctccgtggggcctcctgctactctggctccgagatgccagatgtgaccacccagatcgaccctagtcctccatccctccctgtcctgctatcgtggagggacgacagagtctatactacttcgttcgttcgggccgggactaacgtcgtaaggtaggtttagtttaacgtttaaatttttaaagttttaaagtttggttattaccgtaaacgttaacccgaaaaccggtaacggggtaaaacctacccccgtaacgtcccttacccgttaggtaccttacgttacgtcggtccttacgtactaccttaacccgttaaaggtttaaacccggtaacgggttacccgggtaccctaagttccggtaaacggttcgtaacggtgggacgtaaggttacggtacgttacggtagggactagttaccgtttacacccgtctacccacgtactacgtacgtacgtacctaacgtaccgtaagtacgttaatttacactacgttactctactactagtagtactacgtacctaccctcctacgtcctacgttaccggagggtaccgagtaaggtagtacgtaaacgtaacggtaacgttacggacgtcggtactacgtactaccgttattctcgtttcctcgtccc

SEQ ID NO: 70863 - DNA, 747 bp, Homo sapiens
  misc_feature: GYAE6OF01A6EFT.3.19.B08.1.454.CMB.1.raw
  modified_base (195)..(195): a, c, t, g, unknown or other
  misc_feature (195)..(195): n is a, c, g, or t
  modified_base (226)..(226): a, c, t, g, unknown or other
  misc_feature (226)..(226): n is a, c, g, or t
  modified_base (318)..(318): a, c, t, g, unknown or other
  misc_feature (318)..(318): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgaccacccagatcgacccagtctccatccctccctgtctgcatcgtgtggganacagacgtcatcattctcgttcggcccgganaagtcgtaaggtagtttacgtttaagtttaattttaagttttaaagttggttaactacgtaagttaaccgaaaaccgaacggggtaaaaccnccccgtaaagtcccttaccgtaagtacttaccgttaatccggacgttcgacctaacgttaccgttaaagtttaacggtaaacggggttccggtacctaacgttacgtaagggttcgtacgggtggtacgaggttaggtaacttcgggtacggaactaggttactttaccgaccttcgtacctaacctagtaccgtacggttactaccgtaaccgtaacgtagttaacgttacgtttacgaccttaaacgtttacctacgtaccgtaactaacgaagttaccgtacctaacccctaccggtacctaccgtaccgttacggttaccgggacccgggtaaggtaccggtaacggtacggaactaacggtaaccgaaccgttaggtcgtccggctacgacccgtacttacgttccgtcttccttccggtaccc

SEQ ID NO: 70864 - DNA, 649 bp, Homo sapiens
  misc_feature: GYAE6OF01E1DFA.3.19.B08.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (263)..(263): a, c, t, g, unknown or other
  misc_feature (263)..(263): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggnagtcagagtgttagttattaattaattgtatcagttcaaaccaggaacnccctaagctcctgatctatgctgacatccagtttaacgaagtcgggtccatcgtaagtcaggtgctagtaggatcgtagggatagtatttcgactctaccactatactacgttacgtaccttaacaacccgttagtaagttattttacgaccttaaacgtttaccttaactacgtaccaaaccgtaacgtaacgttaaccgtaccttaacccccgtcccgttccgttaccgttaccggttttacggggaccgggtaaccggggtaacccgaaacgggggttacggaaagtaaccggttaacccgaaaaccggtaaccgttacggttacgggaccctaacggtacccaacccgttaagtacccctttacgtttccgttcctaacccg

SEQ ID NO: 70865 - DNA, 717 bp, Homo sapiens
  misc_feature: GYAE6OF01E5A38.3.19.B08.1.454.CMB.1.raw
  modified_base (96)..(96): a, c, t, g, unknown or other
  misc_feature (96)..(96): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
tcagagacgcactccacgaccggtgctcgatttagtgagtcagtaagggggagccagtctcagtcaggacacagcatggacatgagggtcccccgntcagctcctggggctcctgctactctggctccgagatgccagattgtgaccacccagatcgacccagtctccactccctccctgtctgcatctggtggganacagngtcatcatcctcgttcggccggactaagtcaggtgttagttaagttattttaattaaattggtatcgtagtaccaaacgaggaacnccctaagctctgtatctactgctnactacgtacctaagtttacgaacggtcgggtaccctagtacgtaagttcagtcgcgaggttcgagtcggtaggtaacgtagtacgttcctacttacctacctaaccctagtaccgtaacgttaccgtaacctacctaaacccggtaagttaacgttacgttttacgaaccttaaccttaccgtttaataccgtaactaacgtaacgttaaccgtaacccgttacccgttacccccgtcccgttaaccgttacccttacggggttacccggtaccgggggtaacggtaaacccggtagggttaccgggaaacgtaccgtaaaccgtaaaccgttaacggttgggtacccgacggttaccgacccgtaaacgttccgtaagtttcccgtttacgtacccgttacccg

SEQ ID NO: 70866 - DNA, 709 bp, Homo sapiens
  misc_feature: GYAE6OF01A5RPB.3.19.B08.1.454.CMB.1.raw
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
  modified_base (308)..(308): a, c, t, g, unknown or other
  misc_feature (308)..(308): n is a, c, g, or t
  modified_base (694)..(694): a, c, t, g, unknown or other
  misc_feature (694)..(694): n is a, c, g, or t
tcagagacgcactccacgaccggtgctcgatttagtgagtcagtaagggggagccagtctcagtcaggacacagcatggacatgagggtcccccgctcagctcctggggctcctgctactctggctccgagatgccagatgtcgaccacccagatcgaccctagtcctccatccctccctgtctgcatctggtggagacagagtcatccatctcgtgccgganagtcagtagttgttagttatttaatttaagttggtatctagtacaaacgaaggaaacncccctaagctacctgtactctatgctnctactactaagttaacgtacggtcgggtacctacgtcgtaaggttcaggtgacgtagtgtagtcgtacggaactagtacgtttccacgtcctactaaccgtatacgtaagttacgttaacctaaacctaacccgttaaggttaactttaacgtttaaccgtaaccttaaaccgtttaccgtaacgttaccgtaaccgaaacgtaggtaacccttaaccgtaacccgttaaccccctcgttaacccttaccggtttaccgggttaaccgggaccgggtaaccgggtaaaccggtacggggttaacggaaacgttaaaccgtaaacccggtaaacgtaacggttcgtacggtacctccggaacttaaccggtcttacggtttaccttnttcccggttaacccg

SEQ ID NO: 70867 - DNA, 924 bp, Homo sapiens
  misc_feature: GYAE6OF01A9L4X.3.19.B08.1.454.CMB.1.raw
  modified_base (98)..(98): a, c, t, g, unknown or other
  misc_feature (98)..(98): n is a, c, g, or t
tcagagacgcactccacgaccggtgctcgatttagtgagtcagtaagggggagccagtctcagtcaggacacagcagtggacatgacgggtcccgctnagctccgtgggctcctgtctactctggctccgagatgccagatgtcgaaccacccaggactacgaccctagtcctcctacgttccccttccgtgttacttcgactacgttcgttgggtaggggaacacgagtacgtcaactctacttcttccgtacggcccggagtaacgtacgtaaggttagttagtttaagtttaatttaagttttaaacgttggttactacgtaacgttaaccaaaaccggtacggtaaaccgtacccgtaacgtccttaccgtaggtacttacgtacgtacgtccgtcgtaaccttacgttaaccgtaacggtttaaacggaaccgggtacccggttaacctaagtacccggttaacggtacggtaacggtacgggtacggtagggttacggtaaccggttcgggaacgggttaacttaacggtaccgttttacccgtaacccttacccggtaaccttaacccgttaacgttaacccgttaaggtttaacccgttaaccccgtaaacgttaaaacccggttacggttaaacggttttacgtttaaccctaacgtttaaaaccttacggttaaccttaccgtaaccgttaaggtaaacccggttactttaacccgtaccctttacccccgtacgttcccgttacgggtttcccggtaacggggtaaccggggtaaggggtaaacccggtagggttaaacgtaaaccgtaagttaaaaccccggtaaacggttacggtacggggttaccgaacggtccgttaaaccgtcccgtttacggtaacccttttcttacccggttaacccgttccccgg

SEQ ID NO: 70868 - DNA, 814 bp, Homo sapiens
  misc_feature: GYAE6OF01BN7N9.3.19.B08.1.454.CMB.1.raw
tcagagacgcactccacgaccggtgctcgatttagtgagtcagtaagggggagccagtctcagtcaggacacagcatggacatgagggtcccccgctcagctcctggggctcctgctactctggctccgagatgccagatgtgacacccagatgacccagtctccatccctccctgtctgcatctgtgggagacagagtcatcatcttcttcggacccgggacaagtcgaggtagttagtttaagttaattttaatttaaagtttggttatacgtaagtttaaccaaaaccggtaacggggtaaaaccgtacccccgtaaagtccccttaccgtagtaacttaccgttaatcggtcttacgacctaaccttacccgttaaggttttaaccgaaacggggttccggggtacccctaagtttaaccgtaacgggtttacgagggttacggtacgtagggttaggtacgttccggtacgggaactacgttacttttaccgtaccttaccgtacctaacccgtactaccgttaacgtttacgtaacccttaaccgtaaacccgttaaggtaacgtttaacgttttacgaaccctttaacgtttaacccttaacgttacgttaaccgaacgtaacggtaaccgtttaccgtaacccttaccccccgtccgtacccgttaccgttaccggtttacccgggacgggtaaccgggaaccggtagggtacggtaaccggtaactaaccggtaaacggttaccgtacggtcgggaccttcggaacccctaacgtcgttacccgttcttcccgttaccgtccccg

SEQ ID NO: 70869 - DNA, 651 bp, Homo sapiens
  misc_feature: GYAE6OF01B3XPV.3.19.B08.1.454.CMB.1.raw
  modified_base (195)..(195): a, c, t, g, unknown or other
  misc_feature (195)..(195): n is a, c, g, or t
  modified_base (428)..(428): a, c, t, g, unknown or other
  misc_feature (428)..(428): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtctccatccctccctgtctgctatcgtggtggganacagtagtcatcatctcgttcggccggcaaggtcaggtagttagttagttattttaagtttaagttggtatcgaagttacaaaccggaaggaaacgtacccctaagcctctagtatactatcgcctgaccattacctaagtttaacgaaacggtcgggtacctagtacgtaacggttcgaggtcggacgtagtggacgtcggtaggactacgttacttaccactctacaactntacgtagttactacctaacaacctagtacgttactttacacgttaactttactactacgtaactaacgtaagtaaccgttaccgtaacctacccccgtcgtacccgttacgttaaccggttccgggaccgggtacggaacggtaacgggtaggaacgtacggtaaaccgaacggttacgtcggtcgccgtgtaccctactacgttactcgttctccgttaccg

SEQ ID NO: 70870 - DNA, 739 bp, Homo sapiens
  misc_feature: GYAE6OF01B52B8.3.19.B08.1.454.CMB.1.raw
  modified_base (218)..(218): a, c, t, g, unknown or other
  misc_feature (218)..(218): n is a, c, g, or t
  modified_base (709)..(709): a, c, t, g, unknown or other
  misc_feature (709)..(709): n is a, c, g, or t
  modified_base (719)..(719): a, c, t, g, unknown or other
  misc_feature (719)..(719): n is a, c, g, or t
  modified_base (726)..(726): a, c, t, g, unknown or other
  misc_feature (726)..(726): n is a, c, g, or t
tcagagacgcactccacgaccggtgctcgatttagtgagtcagtaagggggagccagtctcagtcaggacacagcatggacatgacgggtccccgctcagctccgtggggctcctgctactctggctccgagatgccagatgtgaccacccagactcgaccctagtcctaccactccctccctgtacctgctacgtcgtggacgggagacaggacgtntactcaattccttgttacggccgggactaagtcgaggtagttagttaagtttatttaagtttaaagttggtatacgtaacggttaaccaaaaccggtaaggggaaaccgtcccccgtaaaggccttaccgtaggtaacttacgttacgtcggtactcggtacctaactaccgttaaacgtttaacgaaacggggtttcccggggtaccctaacgttacggttaacggttacgaacgggtacggtacgtaaggtacggtacgttaccggtagggtaacctagttacttaccgtaccttaccgtaccctaacgtctacggtaagtcgtaacctaacgtaactaagggttaacttacgttacgaccgtttaacttaccggtaactacgtaacccaagtacgtaacgttacgtaccctacccgtcaccttacgtaccggttcggacgggtacgtaacggtggtacgataaccgtaacgaacgtagcggtcgtacncgacctactnttacgtnttcgtcttacccg

SEQ ID NO: 70871 - DNA, 852 bp, Homo sapiens
  misc_feature: GYAE6OF01BCPV5.3.19.B08.1.454.CMB.1.raw
  modified_base (194)..(194): a, c, t, g, unknown or other
  misc_feature (194)..(194): n is a, c, g, or t
  modified_base (204)..(204): a, c, t, g, unknown or other
  misc_feature (204)..(204): n is a, c, g, or t
  modified_base (286)..(286): a, c, t, g, unknown or other
  misc_feature (286)..(286): n is a, c, g, or t
tcagagacgcactccacgaccggtgctcgatttagtgagtcagtaagggggagccgagtctcagtcaggacacagcatggacatgagggtccccgctcagctcctgggcctcctgctactcgtggctccgagatcgccagatgtgaccacccagactgacccagtcctccactccctccctgtctgcatcgtgngggacacagngtcatcatctcttcggccggcaacgtcgagtagttagttagttattttaattaattgtatctaagttacaaacgaggaaccnccccgtaagtcctcgtgtaatccgttagtgtcgtgacctacgttacccgtaagttaaccgaacgggtccggtaccctagttaccgtacggttcgaagggtcggtagacggttagtacggttacggtacgggtacttacggttactttaccaacccgtttccgtaacctaaccgttacttaccgttaaaccggtttacggttaaacccccttaaacgtttaacccgttaaaggttaaccgtttttaaacgttttacccggaaaccctttaaacccttttaaacccggttactttaacccggttaaccctaaacggtttaacccgggttaacccgttttaaaccccgggacccccttttaacccccggtaccccgtttacccggtttacccggttaaccccggggttttacccggggaacccgggggttaaaccgggtaacccggttaaggggtacccggtaaacgtaaccccggttaaacgggtaaaccgttacgggttaacgggtccggtaacctacccgttcttaaaccggcctttacgttacgtttccccttcgttacccccgg

SEQ ID NO: 70872 - DNA, 852 bp, Homo sapiens
  misc_feature: GYAE6OF01DZ5P4.3.19.B08.1.454.CMB.1.raw
tcagagacgcactccacgaccggtgctcgatttagtgagtcagtaaggggagccagtctcagtcaggacacagcatggacatgacgggtcccccgctcagctcctggggcctccctgctactctcggctccgagactgaccagatgtacgaccacccgagtactccgacccacgtcctacccaccttcccttccctgttctgcctacgtcgtgggtcggaacgacgtagtacgtacactacctacttccgttccggttccggacccgggtactaaacggtaccgtaggtaggtttagttttaagttttaaattttaagttttaaagttggttaacgttaccgttaaacgttaacccgaaaaccggtaaaccgggtaaaccccgtaacccgtaacggtccccttcgtagtaacctttctacgtcgagtacccccccgtattacgttacgttaacgtttaaacgtaacgggttccggtaccgtatacggttaaggtacgaggttcgacgtaggtacgtacgttacggtacggttaacgtacgttacctttaccgaccttaccgaacctaacgtacgtacgtaacgttaactaaccgtaaacgtacgttaagtaacttagttaccgtaaccttacgttaactactaccgtaactacgtaacgttaccgttaaccgaacccttaccccgtacgtaccgtacccggtttacggtacgggtaccggacggtaaccgggtaacgtaaccgggtaacgtaaccgtaaaccggaaacggttaacgggtcgttaacccggacgttacccggaaccgtttaccgtaacctttccgggttaaccctcccgtttactacccccgg

SEQ ID NO: 70873 - DNA, 730 bp, Homo sapiens
  misc_feature: GYAE6OF01DLMBA.3.19.B08.1.454.CMB.1.raw
tcagagacgcactccacgaccggtgctcgatttagtgagtcagtaagggggagccagtctcagtcaggacacagcatggacagtggacgggtccccgctcagcctccgtggggcctcctgctactcgtggcctaccgagatcgccagatgtacgaccaccagactccgacccagtcctccactccctccctgtctcgctatcgtggaggacgactagacgtctatctactccgttcgtacgggaccggtactaaggtcgaaggttacgtttagtttaagtttaagtttttaaacgtttaacggttggttaaccttacgttaaaccgttaaccgaaaccgggtaacggggtaaccctacccgtagtaccctacgtagtacttcgtagtccgacgtcgaacttaccgttaacgttaacgttaacggtacgggtccgtaacctaacgttacggttacgtaggtacggtaggtacgttagggtacgtacgtacggtaacggtacgtacttctacctactacctactaatacgtacgtagtaccgtaactaccaagttagtaacgttcttactaccttacgttacacgttacaataacgtacgttacctacccgtccgttacccgtcgtaccgttacggttaccggtcgggaaccggacggtacgtaacggtagaccgtaataacggtaacgtgtacggcgtacgacgtactacttactctacggtctcgtaccc

SEQ ID NO: 70874 - DNA, 914 bp, Homo sapiens
  misc_feature: GYAE6OF01C7LTR.3.19.B08.1.454.CMB.1.raw
  modified_base (474)..(474): a, c, t, g, unknown or other
  misc_feature (474)..(474): n is a, c, g, or t
tcagagacgcactccacgaccggtgctcgatttagtgagtcagtaagggggagccagtctcagtcaggacacagcatggacatggacgggtcccccgctcagctccgtggggcctcctgctactctggctcgagatcgccagatgtcgaccacccaagactcgacccagtcctcctactccctcccgtgtctcgctacttcgtggtagggacgacaagtacgtctatcctattccttcgttcggaccgggactaagtacgaaggttaggttagttttaagttttaaagttttaagttttaaaagttggttaacttaccgttaagttaaacccgaaaaaccggtaacgggtaaaaccaccccgttaaagcccttaccgtagtacttaccgtagtccggtctacgacctacctttaccggttaaagtttaaccgggaaacgggttcccgggtaaccctagtacggtaccggttagngggtacggacgtaggtcggtacgttacgggaggttaactacgtttacgttaccctaccttacctaacgtaccgtaaacgttccggtaacgtttaaccgtacctaaaaccgttacgtaagtaacgttttactttaaccgaacttttaaaccgtttaacgtaccgttaacgtaaccgtaacgtaacgttaaccgtttaacccgaaccccgttttcccccgtaacccgtttaccgttacccgggttaacccgggtttaacccgggggaaccccgggggtagggtaaacccggttaaaagggggttaacccgtaaaacgggttaacccgtaaaaacccgggttaaaaccggttaccgggttaccggtaaccgggtaacccggttaacctaaccggtaacccgtttaacccgtttcggtttaccttacccgtttcccctaaccgg

SEQ ID NO: 70875 - DNA, 689 bp, Homo sapiens
  misc_feature: GYAE6OF01BDUPP.3.19.B08.1.454.CMB.1.raw
  modified_base (95)..(95): a, c, t, g, unknown or other
  misc_feature (95)..(95): n is a, c, g, or t
  modified_base (439)..(439): a, c, t, g, unknown or other
  misc_feature (439)..(439): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
  modified_base (544)..(544): a, c, t, g, unknown or other
  misc_feature (544)..(544): n is a, c, g, or t
tcagagacgcactccacgaccggtgctcgatttagtgagtcagtaagggggagccagtctcagtcaggacacagcatggacatgagggtccccgntcagctcctggggctcctgctactctggctccgagatgccgagatgtacgaccacccagatcgacccgagttcctccatccctcctgtctgctatcgtggtgggacgacagtacgtctactctacttctccgtacggacccgggtataacggtcgaggtaggttagtttaacgtttatttttaaagtttaagttcgggtaattccgaacgtttaaccgaaaaccggaaggggtaaaccctacccccgttaaggtcccttccgtaagtacttacttagtcgccttgacctaacgttaccgttaaggtttaacgaacgggttcggaacctagttacgtaagttcgnggtcgacgtaggtgtacgtcggaggtacccttagtacttacnccgttactacactntacgtataccgtactaatacgtagtaatttctacgtactaacgttaccngtacaacacgtacggtactccgtacctacccgttctaccgttcgtaccggttcgggacgtaccggtaggacggtacgtacgaactaacggacgtagtcggtctaccgtacacccgtacttacgttcctaacgttcctacgttacc

SEQ ID NO: 70876 - DNA, 786 bp, Homo sapiens
  misc_feature: GYAE6OF01D52NX.3.19.B08.1.454.CMB.1.raw
  modified_base (135)..(135): a, c, t, g, unknown or other
  misc_feature (135)..(135): n is a, c, g, or t
tcagagacgcactccacgaccggtgctcgatttagtgagtcagtaaggggggagccagtctcagtcaggacacagcatggacatgacgggtccccgctcagctccgtggggcctcctgctactctggctccgagntgccagatgtacgaccacccagactcgaccctagtcctcctacttccctcctagtctgctactcgtggtaggggactacgaggtacgtcacttccgtatttccgttccggttacgggcccgggtaacaaggttccgaagggttagtttaacggtttaagttttaaatttttaactttaaaggtttcggttaacttaccggttaaacggttaaaccgaaaaccgggtaacggggtaaaccctaccccgttaagcccttacggtagtactacgttagtccgcgtactacctacgtaccgttaagttaaacggacggttcccgggtaactaggttacggtaacggtaacggtcggtacgacgggttacggtaggttacgtaccggggttacaacgtttaactttccgtttaacacccggttctaacgtacccttaatacggttactaacgtaccgtaacgttaacgtaagttactttcgtaactacgttaacttactacgttagaacttacgtaacgtacttacgttaacgtttcgtaacgttgttacgtaccttcggacggttacgtaaggtaacggtacgtaacaacgtaacgtaaaccgtgttacggtggaccgttacgcctacggttacttcgtacttcgtacttccccg

SEQ ID NO: 70877 - DNA, 498 bp, Homo sapiens
  misc_feature: GYAE6OF02IYJMV.3.19.B08.1.454.CMB.1.raw
  modified_base (490)..(490): a, c, t, g, unknown or other
  misc_feature (490)..(490): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaaattggtatcagttcaaaccagggaaagcccctaagctcctgatctatgctgcatccagtttacaaagtgggtccatcaaggttcagtggcagtggatctgggacagatttcactctcaccatcagtagtctacaaccttgaagtattttgctaacttactactgtcaacagagttacgatacccctcgctcactttcggcgaggaccaaggtggagatacgaaacgtaactgtagctgacaccatctntcttctac

SEQ ID NO: 70878 - DNA, 492 bp, Homo sapiens
  misc_feature: GYAE6OF02HL8JX.3.19.B08.1.454.CMB.1.raw
  modified_base (489)..(489): a, c, t, g, unknown or other
  misc_feature (489)..(489): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaaggttcagtgcagtggatctgggacagatttcactctcacatcagtagtctacaacctgaagtattttagctaacttactactgtacaacagagttacgataccctcgctcactttcgcggaggaccaaggtgagatacgaaacgaactgtaggctgcacatctgtcttntac

SEQ ID NO: 70879 - DNA, 502 bp, Homo sapiens
  misc_feature: GYAE6OF02IZ90M.3.19.B08.1.454.CMB.1.raw
  modified_base (499)..(499): a, c, t, g, unknown or other
  misc_feature (499)..(499): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtgggtcccatcaaggttcagtggcagtggatctgggacagatttcactctcaccatcagtagtctacaacctgaagtattttgactaacttactactgtcaacagagttacgactaccctccgctcctactttcggcggacggacaaggtggagatacgaaacgtaactgtggctgcaccatctcgttcttntac

SEQ ID NO: 70880 - DNA, 496 bp, Homo sapiens
  misc_feature: GYAE6OF02GOZM9.3.19.B08.1.454.CMB.1.raw
  modified_base (493)..(493): a, c, t, g, unknown or other
  misc_feature (493)..(493): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagccctaagctcctgatctatgctgcatccagtttacaaagtgggtcccatcaaggttcagtggcagtggatctgggacagatttcactctcaccatcagtagtctacaacctgaagtattttgactaacttactacttgtacaacagagttacgactacccctccgctcactttcggcgacggaccaaggtggagatacgaaacgaactgtgctgcacatctgtctntac

SEQ ID NO: 70881 - DNA, 490 bp, Homo sapiens
  misc_feature: GYAE6OF02GVJQY.3.19.B08.1.454.CMB.1.raw
  modified_base (268)..(268): a, c, t, g, unknown or other
  misc_feature (268)..(268): n is a, c, g, or t
  modified_base (468)..(468): a, c, t, g, unknown or other
  misc_feature (468)..(468): n is a, c, g, or t
  modified_base (487)..(487): a, c, t, g, unknown or other
  misc_feature (487)..(487): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaancccctaagctcctgatctatgctgcatccagtttacaagtgggtcccatcaaggttcagtggcagtggatctgggacagatttcactctcaccatcagtagtctacaacctgaagtattttgctaacttactactgtacaacagattacgatacccctcgctcactttcgcgaggaccaggtgagatacgaaacgactgnggctgacacatctgtcctntac

SEQ ID NO: 70882 - DNA, 486 bp, Homo sapiens
  misc_feature: GYAE6OF02FRCTQ.3.19.B08.1.454.CMB.1.raw
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaagccctaagctcctgatctatgctgcatccagtttacaaagtgggtccatcaaggttcagtggcagtggatctgggacagatttcactctcacatcagtagtctacaacctgaagtattttgactaacttactacttgtcaacagagttacgataccctcgctcactttcggcgaggacaaggtgagatacaaacgaactgtgctgcacatctntctntac

SEQ ID NO: 70883 - DNA, 527 bp, Homo sapiens
  misc_feature: GYAE6OF02JB13K.3.19.B08.1.454.CMB.1.raw
  modified_base (268)..(268): a, c, t, g, unknown or other
  misc_feature (268)..(268): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaancccctaagctcctgatctatgctgcatccagtttacaaagtgggtcccatcaaggttcagtggcagtggatctgggacagatttcactctcaccatcagtagtctacaacctgaatattttgctaacttactacttgtacaactagacgttaacgacttaacccctccgaccttcctactttcgggacggtacgggaaccgtaagggtcggagactacgaaacgtaactggtaggctagcaccgatctcgttcttctac

SEQ ID NO: 70884 - DNA, 583 bp, Homo sapiens
  misc_feature: GYAE6OF02IV8SN.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcaggtggatcgtgggacagtatttcactctcacatcagtagtctacacctagaactattttgactaactttactacttcgtacaacagtagttaacgacttaaccccctccgaccttacctaccgttttccgggaccgggtaacgggtaacccgaagggttcgggagtaacgttaaccgaaaacggtaaaccgttagggtaccggtacgttggacctaacccgtattacccgtacgtttccttccttaaccg

SEQ ID NO: 70885 - DNA, 494 bp, Homo sapiens
  misc_feature: GYAE6OF02I35WN.3.19.B08.1.454.CMB.1.raw
  modified_base (491)..(491): a, c, t, g, unknown or other
  misc_feature (491)..(491): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagattcactctcaccatcagtagtctacaacctgaagtattttgctaacttaactacttgtacaacagattacgatacccctcgctctacttcgcggacggaccaaggtgagatacgaaacgtactgtgctgcaccatctgtctntac

SEQ ID NO: 70886 - DNA, 682 bp, Homo sapiens
  misc_feature: GYAE6OF02IFTJF.3.19.B08.1.454.CMB.1.raw
  modified_base (340)..(340): a, c, t, g, unknown or other
  misc_feature (340)..(340): n is a, c, g, or t
tcagagacgcactccacgaccggtgctcgatttagtgagtcagtaaagggggagccagtcgtcaagtcaccggacacccagactactgggactactgtacgggtcccgctcagctcctggggactcctgcgtactctcgctcggagtagtgccagatggtttcgtacgtacccagtattagtaaacccgtagttcctccgattccctacccgttgtcctgcctagttcgtggtgggagggacgagtaggtcaatcctagtcgttccttggaccgggactaagtccaggagtcgttagttactttatttaaagttgttacttcagttcaaactaggaaacnccctaagcttcgatactctagtcgctaggacgacttcgtaagttttacgtaagtcgggtacccagttcgtaaggttctaggttagtttaacaggtgaattcgtaggtactagtaacgttccacttctaccactactcaaggtactactaacaactagacgtatttgactaacttactactagtacaaactagtacttacgaccttacccgtccgtacgtaccgtaccgttcggacggtaacgggtaacctaagggtacggaggtaacgtaacggtaaacggtaccggtgtacggtacgtcgtaccttacccgtacgttccggtacgttacccgtacctaccg

SEQ ID NO: 70887 - DNA, 492 bp, Homo sapiens
  misc_feature: GYAE6OF02IU2FU.3.19.B08.1.454.CMB.1.raw
  modified_base (268)..(268): a, c, t, g, unknown or other
  misc_feature (268)..(268): n is a, c, g, or t
  modified_base (339)..(339): a, c, t, g, unknown or other
  misc_feature (339)..(339): n is a, c, g, or t
  modified_base (489)..(489): a, c, t, g, unknown or other
  misc_feature (489)..(489): n is a, c, g, or t
tcagagacgcactccacgaccggtgctcgatttagtgagtcagtaaggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaaattggtatcagttcaaaccagggaaancccctaagctcctgatctatgctgcatccagtttacaaagtgggtcccatcaaggttcagtgcagtgatcnggacagatttcactctcaccatcagtagtctacaacctgaaagtattttgactaacttactactgtacaacagattacgataccctcgctcactttcgcggtaggaccaaggtgagatacgaaacgactgtgctgcaccatctagtcttntac

SEQ ID NO: 70888 - DNA, 490 bp, Homo sapiens
  misc_feature: GYAE6OF02HPBCW.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaaggttcagtgcagtggatctgggacagatttcactctcaccatcagtagtctacaacctgaagtattttgctaacttactactgtacaacagagttacacgtaccctcgtacttttggccagggaccaagctgagatcaaacgaactgtgctgcacatctgtcttcattcc

SEQ ID NO: 70889 - DNA, 677 bp, Homo sapiens
  misc_feature: GYAE6OF02JHSUS.3.19.B08.1.454.CMB.1.raw
  modified_base (181)..(181): a, c, t, g, unknown or other
  misc_feature (181)..(181): n is a, c, g, or t
  modified_base (262)..(262): a, c, t, g, unknown or other
  misc_feature (262)..(262): n is a, c, g, or t
tcagagacgcactccacgaccggtgctcgatttagtgagtcagtaaggggagccagtctcagtcaggacacagcatggacatgagggtccccgctcagctcctggggctcctgctactctggctccgagatgccagatgtgacacccagatgacccagtctccatccctcctgtctgactntctggtggacgacagtacgtcatctatcttcgtcggccggataacgtcgagtagttgttagttatttaatttaagtgtatntagttacaacgaggaaccacctaagctcctagactctatgctgactactcgtaagttaacgaaggtccgggtaccatacgtaacgtacaggtcgacgtagtggtatcggtaggactagttacttacacgttctacactactacgtaagtacgtacctaactacgtagtaagttatttacgaacttaactttactacgttactaactaaacgtagtaaccggttaactaacccgttaccccctaccgtacttaacccggttaccggttttaccgggaccggggtaaaccggaacccggttaagggtaccggtaagttaaccgtaaaccggtaaaaccggttacgtagggttacccgtaccgttacggaccctaacgttaccgttaccggtttaccgttaccttacccttaacccgg

SEQ ID NO: 70890 - DNA, 546 bp, Homo sapiens
  misc_feature: GYAE6OF02HB3WX.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccggcaagtcagagtattagtacctggttggcctggtatcagcagaagccgaagggaaacgcccctaacctcctgactctatgatcgcctcctagtttggctaaggtcggggtccagtacaaggttcaggcggacaggtggagtcgtgggacagaattcactctacaccatcagcagcctgcacgcctagattgtattttcgcttaacttattacctcgacctaactagtaactaacgtaccgtcgtacggaccgttcggaccgagggtaccgtaagggtcggtaagacgtacgtaagtaaccggtaacgttcggtacggtctacggacctacgtacg

SEQ ID NO: 70891 - DNA, 544 bp, Homo sapiens
  misc_feature: GYAE6OF02GOWNI.3.19.B08.1.454.CMB.1.raw
  modified_base (269)..(269): a, c, t, g, unknown or other
  misc_feature (269)..(269): n is a, c, g, or t
tcagagacgcactccacgaccggtgctcgatttagtgagtcagtaagggggagccggagtctcagtcaggacacagcatggacatgagggtccccgctcagctcctggggctcctgctactctggctccgagatgccagatcgtgacacccagatgacccagtctccatcctccctgtctgcatctgtgggagacagagtcatcatctcttgccgggcaagtcagagtgttagtatttattaaattggtatcattcaaacagggaaacncccctaagctccctagatctatgctgcatccagtttacaaagtcgggtaccatcaaggttcagtggcagtggatcgtgggacagactttcactctacactatcagtatctacaacctagaagtattttgactaacttactacttgtacaacagtaacgttacgaacttacccctccgactcgtacgtttcggacggtaacggaccgtaagggtggagtacgtacgaaacgtacgttcggtacggacgtcgacaccgattctcgttccttactacc

SEQ ID NO: 70892 - DNA, 515 bp, Homo sapiens
  misc_feature: GYAE6OF02IZMR2.3.19.B08.1.454.CMB.1.raw
  modified_base (268)..(268): a, c, t, g, unknown or other
  misc_feature (268)..(268): n is a, c, g, or t
  modified_base (507)..(507): a, c, t, g, unknown or other
  misc_feature (507)..(507): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaancccctaagctcctgatctatgctgcatccagtttacaagtgggtaccaatcaaggttcagtggcagtggatcgtggacagtatttcactctcacctatcagtagtctaacacctagaacgtattttcgactaactttactacttgtacaacagtacgttacactacccctcgcctctaccgtttcggcggtaggacccaagggtcggatagtacgaaacgactgtggctgctacatctntcttctac

SEQ ID NO: 70893 - DNA, 557 bp, Homo sapiens
  misc_feature: GYAE6OF02GXFYK.3.19.B08.1.454.CMB.1.raw
  modified_base (214)..(214): a, c, t, g, unknown or other
  misc_feature (214)..(214): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggnaagtcagagtgttagtatttatttaaattggtatcagttacaaaccagggaaagccctaagctcctgatctatgctgcatcctagtttaacaaagtcgggtaccatacaaggttcagtggacagtgatcgtgggacagtattcactctcacctatacagttacgtactaacaaccttagaagtattttagactaacttactacttgtacaaactagtacgttacgactacccctcgtaccttacgtaccgttttccgggacggaacggaaccgtaagggtcgacgaactacgaaacggtaactggtacgacgttagacccactactacgttgttcctgtaccc

SEQ ID NO: 70894 - DNA, 480 bp, Homo sapiens
  misc_feature: GYAE6OF02ICTPM.3.19.B08.1.454.CMB.1.raw
  modified_base (349)..(349): a, c, t, g, unknown or other
  misc_feature (349)..(349): n is a, c, g, or t
  modified_base (402)..(402): a, c, t, g, unknown or other
  misc_feature (402)..(402): n is a, c, g, or t
  modified_base (477)..(477): a, c, t, g, unknown or other
  misc_feature (477)..(477): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccgggcaagtcagagtgttagtatttatttaaattggtatcagttcaaacaggaaagccctaagctctgatctatgctgcatccagtttacaaagtgggtccatcaaggttcagtgcagtgatctgggacagatttcactntcacatcagtagtctacaactgaagtattttgactaacttactactgtacaanagattacgactaccctcgctcactttcgcggaggacaaggtgagatacgaaacgactgtgctgcacatctgtctntac

SEQ ID NO: 70895 - DNA, 510 bp, Homo sapiens
  misc_feature: GYAE6OF02GJ9Z6.3.19.B08.1.454.CMB.1.raw
  modified_base (190)..(190): a, c, t, g, unknown or other
  misc_feature (190)..(190): n is a, c, g, or t
  modified_base (268)..(268): a, c, t, g, unknown or other
  misc_feature (268)..(268): n is a, c, g, or t
  modified_base (418)..(418): a, c, t, g, unknown or other
  misc_feature (418)..(418): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaaccagggaaancccctaagctcctgatctatgctgcatccagtttacaaagtgggtccatcaaggttcagtggcagtggatcgtgggacagtatttcactctcaccatcagtagtctaacaacctgaagtattttgactaacttactacttagtaccaaanagtagttaaccacttacccctccgtctcctactttcggcgaggaccaaggtgagtacacgaaacgactgtcgctagcacattcngtctntac

SEQ ID NO: 70896 - DNA, 535 bp, Homo sapiens
  misc_feature: GYAE6OF02IUV1K.3.19.B08.1.454.CMB.1.raw
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (274)..(274): a, c, t, g, unknown or other
  misc_feature (274)..(274): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
  modified_base (522)..(522): a, c, t, g, unknown or other
  misc_feature (522)..(522): n is a, c, g, or t
tcagagacgcactccacgaccggtgctcgatttagtgagtcagtaagggggagccagtctcagtcaggacacagcatggacatgacgggtccccgctcagctccgtggggctcctgctactctggctccgagatgccagatgtgacacccagatgacccagtctccatccctccctgtctgcatctggtgggagacagagtcatcatctctgccggnaagtcagngtgttagtatttaattaaattggtatctagttacaaacgaagggaaacncccctaagctcctgatctatgctgcatcctagttaacaaaggtcgggtccatcaaggtcagtgcagtgatcgnggacagtattcactctcacatcagtntactacactgaagttatttgacctaacttactactntacaactagtagttaccgacctacccctccgtctcctacgtttcgggacggacggaacgtagggtgagactaacgaaacgtacgtggtacggcgtagaccaccgtattccgtnttaccgttctacc

SEQ ID NO: 70897 - DNA, 528 bp, Homo sapiens
  misc_feature: GYAE6OF02HD74V.3.19.B08.1.454.CMB.1.raw
  modified_base (190)..(190): a, c, t, g, unknown or other
  misc_feature (190)..(190): n is a, c, g, or t
tcagagacgcactccacgaccggtgctcgatttagtgagtcagtaagggggagccagtctcagtcaggacacagcatggacatgtgggtccccgctcagctcctggggctcctgctgctctggctcccaggtgccaaatgtgacatccagatgacccagtctccctccaccctgtctgcatctttagganacagagtcaccatcacctgccggccagtcaaagtattagtaactcgttggcctggtatcagcaaagaccaggcagagccccaaagctaccttatctctgatgcctcaatttgcacagtcggggtcccaccaacgttcagcggcagtggatcgtgggacagtacgtcactcctcaccatcagcagcctgcacgcctgaccgatgtggaccaactttacttactagaccaactagttatacgaattagtttaattcggtaacgttcggaccgaagggaaccaagagtaacgaaataacaaacgtaactggtacgactcgacaccgtactacgtgttaccg

SEQ ID NO: 70898 - DNA, 541 bp, Homo sapiens
  misc_feature: GYAE6OF02HIFXH.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattttatttaaattggtatcagttacaaaccagggaaacgccctaagctcctgatctatgctgcatccagtttacaagtgggtccatcaaggttcagtggcagtggatcgtgggacagtatttcactctcacatcagtagtctaactaactgaagtattttgactaaactttactacttgtacaactagtaagttaacgacttaccccgtccgacttcctacgtttccgggacgggacggaaccgtaagggtggagtaacgtacgaaaacggtactaggtggctacgctaccagttctcgttcttctacc

SEQ ID NO: 70899 - DNA, 501 bp, Homo sapiens
  misc_feature: GYAE6OF02FO3MW.3.19.B08.1.454.CMB.1.raw
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaagccctaagctcctgatctatgctgcatccagtttacaaagtgggtccatcaaggttcagtgcagtggatctggacagatttcactctcaccatcagtagtctacaactgaagtattttgctaacttactacttgtacaacagtagttacgactacccctccgacttcctactttccggacggtaggaccaaggtgganatacgaaacgactggtcgctagcacatctgtctntac

SEQ ID NO: 70900 - DNA, 541 bp, Homo sapiens
  misc_feature: GYAE6OF02H7AJA.3.19.B08.1.454.CMB.1.raw
  modified_base (191)..(191): a, c, t, g, unknown or other
  misc_feature (191)..(191): n is a, c, g, or t
  modified_base (440)..(440): a, c, t, g, unknown or other
  misc_feature (440)..(440): n is a, c, g, or t
  modified_base (536)..(536): a, c, t, g, unknown or other
  misc_feature (536)..(536): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatcgtgtggganacagagtcatcatctcttgccggcaagtcagagtgttagttatttatttaaattggtatcagttcaaacgaggaacgccctaagctcctgatctatgctgcatcctagtttacaaaggttcgggtacccagtacgtaaggttcaggttggacagtggatcgtagggacctagtaatttccgacttctaccacctatcagtacgtactaactaacctagaagtattttgactaacttactactgtacaanagtacgttacgacttacccgtcgtctctacgtttcgacggtaggaccgaaggtgagtagtacgaagtactggtgtcgagcactactctcgttcctntaccg

SEQ ID NO: 70901 - DNA, 514 bp, Homo sapiens
  misc_feature: GYAE6OF02F6JS2.3.19.B08.1.454.CMB.1.raw
  modified_base (267)..(267): a, c, t, g, unknown or other
  misc_feature (267)..(267): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaancccctaagcctcctgatctatgctgcatccagtttaacaaaggtcgggtcccatcaaaggttcagtggcagtggatcgtgggacagtatttcacttctacaccatcagttacgtactaacaacctagtaagtattttcgactaacttactactgtacaacagtagttacactacccctcgactctacgtttcggcggaggaccaaggtgagatacgaaacgatgtgctgacacatctcgttctctac

SEQ ID NO: 70902 - DNA, 649 bp, Homo sapiens
  misc_feature: GYAE6OF02GUJOX.3.19.B08.1.454.CMB.1.raw
  modified_base (215)..(215): a, c, t, g, unknown or other
  misc_feature (215)..(215): n is a, c, g, or t
  modified_base (627)..(627): a, c, t, g, unknown or other
  misc_feature (627)..(627): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctctgccggnaagtcagagtgttagttatttattaaattggtactagtactaacgaacggaagaccctacgtactcctacgtagtacttactgtcgtcgtcactactacgttaacgtaacggtacgggtccgtactacgtaacggttacgtagtaggtacgtagtaggtagtacgtaggtagtacgtatttctacctcttacactactactaagttacggtaccttaacaaccttacgtaaagttacgtttacgtacctaaacctttacttaaccgttagttaccgtaaactacgtaagtttaaccgtaccttacccccttcccggcttaccgttacgttaccgggtaccggggaacgggtaacgaaacgggtggacggtaatacgtaaaccgaacgtgtcgggacttcgacgacctacgtnttccgtttcttccacttacccg

SEQ ID NO: 70903 - DNA, 493 bp, Homo sapiens
  misc_feature: GYAE6OF02GH93J.3.19.B08.1.454.CMB.1.raw
  modified_base (190)..(190): a, c, t, g, unknown or other
  misc_feature (190)..(190): n is a, c, g, or t
  modified_base (266)..(266): a, c, t, g, unknown or other
  misc_feature (266)..(266): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaaattggtatcagttcaaacagggaaancccctaagctcctgatctatgctgcatccagtttacaaagtgggtccatcaaggttcagtgcagtggatcgtggacagtatttcactctacaccatcagtagtctacaactgaagtattttgactaacttactactgtcaacagtagttacactaccctcgctctactttcggcgacggaccgaaggtgagatacgaaacgaactggtgctgcacatctgtctctac

SEQ ID NO: 70904 - DNA, 507 bp, Homo sapiens
  misc_feature: GYAE6OF02G9JDF.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacagggaaagcccctaagctcctgatctatgctgcatccagtttacaaagtgggtcccatcaaggttcagtggcagtggatcgtgggacagattcactctcaccatcagtatctacaacctgaagtatttcgctaacttactactgtacaactagagttacgatacccctccgctctacgtttcggcggtaggaccgaaggtggagtatacgaaacgtactggtaggtctgaccacatctgttctactac

SEQ ID NO: 70905 - DNA, 656 bp, Homo sapiens
  misc_feature: GYAE6OF02IAPFE.3.19.B08.1.454.CMB.1.raw
  modified_base (273)..(273): a, c, t, g, unknown or other
  misc_feature (273)..(273): n is a, c, g, or t
tcagagacgcactccacgaccggtgctcgatttagtgagtcagtaagggggagccagtctcagtcaggacacagcatggacatgagggtcccgctcagctccgtgggctcctgctactctggctccgagatgccagatgtgacacccagatgacccagtctccatccctcctgtctgcatctgtgggagacagagtcatcatctcttgccggacaagtcagtagtgttagttatttaatttaagttggtatcagttacaaacgtagggaaacnccctaagcctctagactctatgctgcactcctaagttaacaaggtcgggtaccagtacgtaaggtacagtggcaggtgatcgtagggactaagtacttcactctaccactatccgtagtacgtacctaactaactagtaagttattttacgaacttaactttaaccgttacttacgtacctaaacgtaggtaccgttaacgtacccttaaccccgttccgtaccttaccgtaccggttttccgggaaccgggtaaacgggtaacccgttaaaggggtacgggtaacgtaacgtaaccggtaaaaccgtaacgttcgggtaccggttaccgtacggtaacccgacccgttagttacccgttacgttacctttacccttaacccg

SEQ ID NO: 70906 - DNA, 589 bp, Homo sapiens
  misc_feature: GYAE6OF02HQE6R.3.19.B08.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (407)..(407): a, c, t, g, unknown or other
  misc_feature (407)..(407): n is a, c, g, or t
tcagagacgcactccacgaccggtgctcgatttagtgagtcagtaaggggggagccagtctcagtcaggacacagcatggacatgagggtccccgctcagctccgtggggctcctgctactctggctccgagatgccagatgtgacacccagatgacccagtctccatcctccctgtctgcatctggtggganacagagtcatcattctcttcggccgggnaagtcagagtgttagtatttatttaaattggttatctagttacaaaccgagggaaacgcccctaaagccttcctgatctatgctgcatccagtttacaagtgggtaccatcgaagttcagtgcagtggatcgtgggacagtactttacacttctcacatctagtacgtctaactaacctagaagtntttagactaacttactactagtacaaactagtaacgttacaacttacccctccgtacctaccttacgtttccgggaccgggtaaacggtaacccgaagggttacggacgtacgtaaccgaaaccggtaacgttggtacggtacctaggacctaccgtattccgttcgttccttactaacccg

SEQ ID NO: 70907 - DNA, 529 bp, Homo sapiens
  misc_feature: GYAE6OF02HRDPF.3.19.B08.1.454.CMB.1.raw
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggnaagtcagagtgttagtatttatttaattggtatctagttcaaacaggaaanccctaagctcctgatctatgctgcatctagtttaacaaagtgggtccagtcaaggttcagtgcagtggatcgtgggacagtatttcactctcactatcaagtacgtctacaactgaagtatttgactaacttactactgtacaaacagtaacgttacgactacccctcgactcctaccgtttcgccgggaggaccgaagggtcggacgtagtacgaaacgtacctggtacggtactcgactaccatccgttatccttactaccg

SEQ ID NO: 70908 - DNA, 517 bp, Homo sapiens
  misc_feature: GYAE6OF02JFJF1.3.19.B08.1.454.CMB.1.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtatcagttcaaacagggaaancccctaagctcctgatctatgctgcatccagtttacaaaggtcgggtacccatcaaggttcaggtggcagtggatcgtgggacagtatttcactctcaccatcagtagtctaacacctgaatatttgactaacttactactgtacaacagtacgttacgactacccctcgcctactacgtttcggcggtacggaccgaaggtgagatacgaaacgactggtgctgacacgtatcgtacgttcttctaccg

SEQ ID NO: 70909 - DNA, 502 bp, Homo sapiens
  misc_feature: GYAE6OF02FOSWB.3.19.B08.1.454.CMB.1.raw
  modified_base (499)..(499): a, c, t, g, unknown or other
  misc_feature (499)..(499): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaagcccctaagctcctgatctatgctgcatccagtttacaaagtgggtccatcaaggttcagtgcagtggatctggacagatttcactctcacatcagtagtctacaacctgaagtatttgactaacttactacttagtacaacagtacgttacgactacccctccgctctacgtttcggcggtacggaccaaggtggagatacgaaacgacgtgtggctgacacatctgtcttntac

SEQ ID NO: 70910 - DNA, 529 bp, Homo sapiens
  misc_feature: GYAE6OF02JIXPO.3.19.B08.1.454.CMB.1.raw
  modified_base (188)..(188): a, c, t, g, unknown or other
  misc_feature (188)..(188): n is a, c, g, or t
  modified_base (219)..(219): a, c, t, g, unknown or other
  misc_feature (219)..(219): n is a, c, g, or t
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
  modified_base (421)..(421): a, c, t, g, unknown or other
  misc_feature (421)..(421): n is a, c, g, or t
tcagagacgcactccacgaccggtgctcgatttagtgagtcagtaagggggagccgagtctcagtcaggacacagcatggacatgacgggtccccgctcagctcctgggctcctgctactctggctccgagatgccagatgtgacaccagatgacccagtctccatcctcctgtctgcatctgtgganacagagtcatcatctctgccggcaagtcagngtgttagtatttatttaaattggtatctagttacaaacgaggaacnccctaagctactgtatctangtctgacactctagttacgaagtcggtaccatgtagtnagtgcagtgactcgtggactgtattcacgtctacactanactagtagtactaactaacgtataagtctttagaccttaacttattcctagtactaacngtaacttcgaactccctacgctacgtacgttcggtacgacgacgtaggtacgacgtaataccgaaacgtacgtgtacgtctacgactacgtatcgttcgtcttagacc

SEQ ID NO: 70911 - DNA, 579 bp, Homo sapiens
  misc_feature: GYAE6OF02IIDOE.3.19.B08.1.454.CMB.1.raw
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (335)..(335): a, c, t, g, unknown or other
  misc_feature (335)..(335): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagttatttatttaaattggtatnagttcaaacagggaaanccctaagctctgatctatgctgcatcagtttaacaagtgggtccatcaagttcagtgcagtgatcgngggacagtattccatctcacctatcagtagtctaacacctagaagtattttgactaactttactaactctacaacgtagtaacgttaacgaccttacccctccgtaccttaccgttacgttttaccgggaccgggtaacgggtaaccgaagggttacgggaagacgtaaacggaaaccggtaaaccgttgggtacggtacgtacgacctaaccgtacgttccgttacgttacctttctaacccg

SEQ ID NO: 70912 - DNA, 558 bp, Homo sapiens
  misc_feature: GYAE6OF02HQ2CB.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaattggtatcagttcaaacaggaaagccctaagctcctgatctatgctgcatcctagttacaaagtgggtcccatcaaggttcagtgcagtgatcgtggacagtatttcactctcaccatacagtatctacaactgaagtatttgactaacttactactgtacaacgtagtacgttaacacttacccctaccgtcctactaccgtttccgggaccgggtacggaacccgaagggtggagtacgtaaccgaaaacggtaaccgttacggtacggtaccgtcggtaccaaccctagttaccttacgttcctttctaacccg

SEQ ID NO: 70913 - DNA, 698 bp, Homo sapiens
  misc_feature: GYAE6OF02HY6YK.3.19.B08.1.454.CMB.1.raw
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatgacccagtctccatccctccctgtctgcatctggtgggagacagagtcatcatctcttggccggcaagtcagagtgttagtatttatttaattggtatctagttacaaaccgtaggaaagccctaagctctagatctatgctgctatacctagtttaacaaaggttcgggtaccctagtacgtaaggttaccgaagttggacgtaggttacggtagtccgtaaggggactaagtacttttccgactcctacgtaacctatacgtacgtacgttacctaaccgtaaacctagtaaagttaacgttttacgtaaccttaaacttaaccgtttaccttaacggttaacctaaaacgtaacggtaacgttaacggttaacccttaacccccgttcccgtaccttacccgttaaccgttttaccgggccgggtaaacgggtaaccggtaagggtagggtaacgtaacgttaacgaaaacccgtaacgttacggtacggtacgtacggtaccaacccgtaacgttcctacggtttaccttacgttaacccg

SEQ ID NO: 70914 - DNA, 528 bp, Homo sapiens
  misc_feature: GYAE6OF02JJFFO.3.19.B08.1.454.CMB.1.raw
  modified_base (190)..(190): a, c, t, g, unknown or other
  misc_feature (190)..(190): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttattaaattggtatcagttcaaacaggaaagccctaagctcctgatctatgctgcatccagtttacaagtgggtaccatcaagttcagtggcagtggatcgtgggacagtatttcactctcaccatcagtagtctacaactgaatattttgactaacttactacttagtcaactagtagttacgattacccctccgtactcctacgtttcggcggaaggtacccgaaggtcggatacgtactaaacggaacttaggtacgtactcgactaccgtataccgtgtccttcgtaaccg

SEQ ID NO: 70915 - DNA, 529 bp, Homo sapiens
  misc_feature: GYAE6OF02HUR3H.3.19.B08.1.454.CMB.1.raw
  modified_base (190)..(190): a, c, t, g, unknown or other
  misc_feature (190)..(190): n is a, c, g, or t
  modified_base (275)..(275): a, c, t, g, unknown or other
  misc_feature (275)..(275): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcgtgccgggcaagtcagagtgttagtattttaatttaaattggtatctaagttacaaaccgagggaaacncccctaagcctcctgatctatgctgcacttcctaagttttaacgaaaggtcgggtaccctagtaccaaggttcaggtggcaggtgatgtaggacagtacttcactctcacatcagttacgtctaacaactagaattactttagactaacttacttactgtacaagagtaacgttacaacctaccctctctacgtacgttcgcggacgacgagtgagacgtacaacgtactgngctgcacnttctcttctctacg

SEQ ID NO: 70916 - DNA, 580 bp, Homo sapiens
  misc_feature: GYAE6OF02GSZRH.3.19.B08.1.454.CMB.1.raw
  modified_base (409)..(409): a, c, t, g, unknown or other
  misc_feature (409)..(409): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtacctggttggcctggtatcagcagaagccgaagggaaacgcccctaacctcctgatctatgatcgcctcaggtttggactaaggtcggggtcccagtcgaagggttcaggcggcaggtggatcgtgggacagtaattcactctacaccatcagcacgcctgccagcctgatgtattttnacttaactttattacctcgaaccctaactacgttaacttaaccgtacccgtcgttacgtaccggtttaccggaaccgtaacggggtaacccgtaaggggtacgggaagttaacgtaccgtaagttaaccggtaacggttcggtaccgggtactacggaccctaccgtaacg

SEQ ID NO: 70917 - DNA, 742 bp, Homo sapiens
  misc_feature: GYAE6OF02FP4I7.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagacgccccaaagctccttatctctgatgccctcctaattttcgacaacgtacggttcggggtaccccctaaccgtaaaccgtttccgacggaccgggcgtaggtacgggtatcgtggggaacgaagtaacggtttccaaccgttcccgttaccaaccctacgttaccgaacgtacccgaacggtacccgttacggacccacggtaccctacgggaaccgtaagttcggttacggggtacctaaaacttttaacctttaaccgtaccgtaacccgtaaacgtaaggttaacttagttaaacgtttaacggttttaaacgtttacggggttaaccggtttaccgggtaacccggtaaacggggtaaccccgtaagggtaacgtaaacggtaaaaccgttaaccgtaaaaaccggtaaaccgttaggttacgggtacgttacggaacccgtaaccgtaccgttaccgttaggtttacccc

SEQ ID NO: 70918 - DNA, 609 bp, Homo sapiens
  misc_feature: GYAE6OF02IXYOS.3.19.B08.1.454.CMB.1.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccggacaagtcagngtgttagttatttatttaaatggtatctagtacaaacgaggaacnccctaagctacctgatctatgctgcatcctagttaacaacggtgggtacccatacgtaacggttctaggtagactagtggtatcgtaggactagtatttaccacgttctactacactcgaagttacgtctaacctaacgtgtaaagtatttacgacctaacttacttactgtaccaactagtacttacgtaaccttaccccgacgtccttaccttaccggtttaccgggaccgggtaacggaaccgtaacgggttggaacgtacgtaacgaacggtaaacgttcgggtacgtaacgttacgtacctaccgtacgttctacggttaccttacgttacccg

SEQ ID NO: 70919 - DNA, 538 bp, Homo sapiens
  misc_feature: GYAE6OF02ISR9A.3.19.B08.1.454.CMB.1.raw
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (270)..(270): a, c, t, g, unknown or other
  misc_feature (270)..(270): n is a, c, g, or t
  modified_base (534)..(534): a, c, t, g, unknown or other
  misc_feature (534)..(534): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagngtgttagtatttattaaattggtatctagttcaaaaccgaggaaacnccctaagctcctgatctatgctgcatctagttaacaaagttcgggtacccatactaaggttcagtgcagtggatcgtggaacagtatttcactctcacatcagtagtctaacaacctagtaaacttatttagactaaacttactacttacgtacaacagtaacgttactaactacccctcgcttcctacgtttcggacgggtacggaaccgaggtagacgaatacgaaacgtacgtgtaggactagcctaccattctcgttctntacc

SEQ ID NO: 70920 - DNA, 543 bp, Homo sapiens
  misc_feature: GYAE6OF02JB8M4.3.19.B08.1.454.CMB.1.raw
tcagagacgcactccacgaccggtgctcgatttagtgagtcagtaagggggagccagtctcagtcaggacacagcatggacatgagggtccccgctcagctcctgggctcctgctactctggctccgagatgccagatgtgacacccagatgacccagtctccatcctccctgtctgcatctgtgggagacagacgtcatcatctcttgccggcaagtcagagtgttagtatttattaaattggtatctagttcaaaccaggaagccctaagcctcctgatctatgctgcatccagtttacaagtgggtaccatcaaggttcagtggcagtgtatcgtgggactagtattcgatcacacatacagtagtactacaactgaagtatttgactaaacttactactagtactaacacgagttaccgacttacccctaccgcttcgtactttccggacggtacgggaccaagggtcgtaggactacgaaaccgtaaacgtggtacgtactacggtaccaccgtacttccgtagtttccgtaccttac

SEQ ID NO: 70921 - DNA, 557 bp, Homo sapiens
  misc_feature: GYAE6OF02FROQ0.3.19.B08.1.454.CMB.1.raw
  modified_base (214)..(214): a, c, t, g, unknown or other
  misc_feature (214)..(214): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggnaagtcagagtgttagtatttattaaattggtatctagttacaaaccgagggaaacgccctaagctcctgatctatgctgcatcctaagtttaacaaaggtcgggtaccatcaaggttcagtggcagtggatcgtggactagtatttcactctacacctatcagtacgtctaactaacctagaagttatttacgactaacttactactgtacaactagtacgttacgacctacccctccgtcctactacgtttcggacggtaacggacgtaagggtggtacacgtaccgaaacgtaacgttggtcggactgaccaccgtacttcgtcgttccttccctaccccg

SEQ ID NO: 70922 - DNA, 487 bp, Homo sapiens
  misc_feature: GYAE6OF02G7ILK.3.19.B08.1.454.CMB.1.raw
  modified_base (384)..(384): a, c, t, g, unknown or other
  misc_feature (384)..(384): n is a, c, g, or t
  modified_base (450)..(450): a, c, t, g, unknown or other
  misc_feature (450)..(450): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaagcccctaagctcctgatctatgctgcatcagtttacaaagtgggtcccatcaaggttcagtggcagtggatcgtgggacagatttcactctcacatcagtagtctacaacctgaagtnttttagcaacttactactgtacaacagagttacatacccctcgctcactttcggcggaggaccagngagatacgaaacgactgtgctgcacntctgtctntac

SEQ ID NO: 70923 - DNA, 598 bp, Homo sapiens
  misc_feature: GYAE6OF02G95R0.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctcctgtctgcatctggtagggagacagagtcatcatctctgccggcaagtcagtagtgttaagtatttattaaattgtatcagttacaaacgaggaacgccctaagctcctgactctatgctgactactcctaagtttaacaaaggttcgggtaccccaataccgtaaggttcaggtcgacgtagtaggtatcgtagggaactaagttactttacgacttcctacaaccattacgaatacgtacctaacaaccgttagtaaagttactttagacttaaacttaactactagtacaagtacgtaagttacacgtacccctcgtactactacgttcggacggaaggtaccgaagggtgtaacgactaaccgaaaacgtaccgttaggtaccgtagtacgaccgtaactagttccgttagtcctttagaccc

SEQ ID NO: 70924 - DNA, 527 bp, Homo sapiens
  misc_feature: GYAE6OF02I97W1.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacagggaagcccctaagctcctgactctatgctgcatccagtttacaaaggtgggtccatcaaggttcagtggcagtggatcgtgggacagtatttcactctcaccatcagtagtctacaactgaagtatttgactaactttactacttcgtacaactagacgttacgactacccctcgctctacgttcggacggacggacaaggtgagactacgaaacgtaacgttggtacggtctacgactaccgtatccgttcgttaccttataccg

SEQ ID NO: 70925 - DNA, 619 bp, Homo sapiens
  misc_feature: GYAE6OF02HVQL2.3.19.B08.1.454.CMB.1.raw
  modified_base (193)..(193): a, c, t, g, unknown or other
  misc_feature (193)..(193): n is a, c, g, or t
  modified_base (276)..(276): a, c, t, g, unknown or other
  misc_feature (276)..(276): n is a, c, g, or t
  modified_base (356)..(356): a, c, t, g, unknown or other
  misc_feature (356)..(356): n is a, c, g, or t
  modified_base (417)..(417): a, c, t, g, unknown or other
  misc_feature (417)..(417): n is a, c, g, or t
tcagagacgcactccacgaccggtgctcgatttagtgagtcagtaaggggggagccagtctcagtcaggacacagcatggacatgagggtccccgctcagctcctggggctcctgctactctggctccgagatgccagatgtgacacccagatgacccagtctccatcctccctgtctgcatcgtggtggganacagagtcatcattctctgccgggcaagtcagagtgttagtattttatttaaattggtatctagttacaaaccgagggaaacncccctaagcctacctgatctatgctgcatccaagtttaacaaggttcgggtacccagtacgaaggtttcagtaggcaggngatcgtgggactagtatttcactctcaacatcgtagtacgtacaactaacctgtaacgttnttttacgactaaacctttactacgtacgtactaaacgtagtaacgttaacaaccgttacccctacccgtaccttacgtaaccgtttcgggacgggtaaacggaaccgtaagggtacggaagaacgtaaccgtaaaacggtaaccgttaggtacggtccgtacgtaccgtaccgtagttacgttacgttccttaccgtaaccg

SEQ ID NO: 70926 - DNA, 578 bp, Homo sapiens
  misc_feature: GYAE6OF02GHYTC.3.19.B08.1.454.CMB.1.raw
  modified_base (270)..(270): a, c, t, g, unknown or other
  misc_feature (270)..(270): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttacaaaccgagggaaacncccctaagcctcctgatctatgctgcatcctagtttaacaagtcgggtcccatacgaaggttcagtgcgtagtaggatcgtacgggactaggtatttccactctacaccatacgtagtatctacaacctagtaattatttgacttaaccttactactagtacaaacgtagtacgttaacgtacctaacccgtccgtacctaccgtacgtttccggacgggtacggaaccgtaagggtcgacgactaccggaaaacgtacgttaggtacggtctacgaccgacctacttcgtcggttacctcgtaaccc

SEQ ID NO: 70927 - DNA, 657 bp, Homo sapiens
  misc_feature: GYAE6OF02JDYW8.3.19.B08.1.454.CMB.1.raw
  modified_base (284)..(284): a, c, t, g, unknown or other
  misc_feature (284)..(284): n is a, c, g, or t
tcagagacgcactccacgaccggtgctcgatttagtgagtcagtaagggggagccagtctcagtcaggacacagcatggacatgacgggtccccgctcagctccgtggggcctcctgctactctggctccgagatgccagatgtgacacccagatcgacccagtctccatccctccctgtctgcatcgtggtagggagacagagtcatcattccttcgttcggccgggacaagtcagtagttgttagttatttaattaagttgtatctagtacaacgaggaacnccctaagctctgatctatgctgctactctaagtttaacgaaggttcgggtaccctagtacgtaaggttcgaggtcggactaggtggtactacggtagggactagtactttcactcctacactatactaagttacgtacctaaccgtaaccgtagtaaacttagttttacgaaccttaactttactacttacgtaaccaacgttagtaacgttaaccgtaacccttacccccgtccgtaccttaccgttaccggtttccgggaaccggtaaccggtaaccgtaagggttacgaacgtacgtaaccgtaaacggtacgtcggtacggtactacggaccctaaccgtacgttaccgttcgttaccttacctacccg

SEQ ID NO: 70928 - DNA, 735 bp, Homo sapiens
  misc_feature: GYAE6OF02G4D3X.3.19.B08.1.454.CMB.1.raw
tcagagacgcactccacgaccggtgctcgatttagtgagtcagtaagggggagccgggagtctcgagtcaggacacagcgatggacactgagggtccccgcgtcagctcctcgggcctcctgcctactctgctccggagatggaccagagtgtgaccacccagactcgacccagtcctccactccctcctgtctcgctactcgtggtgggacgacgagacgtctactcatccttcgttacgggacccggagaacgtacgaggtagttaggttaggttaattttaaagtttaagttgtacttacgtaacgttaaccaaaccggaacggaaccgtacccgtaacgtcccgtacccgtagtacttacttaagttcgtacgtgtacctacttaaccgttaacggttaaccgtaacgggttccgggtaccctacgtacgtaacggttcgtaggttcggacgtaggtcgtagtacggtacggactaacgtacttccactcctacctacgtactacgtacgtaccgtacctaacgtaaccgtagtaacgttagttaccgaaccttaacgttacgtaacgttactaacgtaacgtacgttacgttacccgttaacccttacccgtcgtaccgttaccgttaccggttaccggacgggaacgtaacggtagggtacgtacgtactaacggaacgtacgtcggtacgtccgtacgacctacgtcgtccgtacgtacctacgtccg

SEQ ID NO: 70929 - DNA, 560 bp, Homo sapiens
  misc_feature: GYAE6OF02JZF6Y.3.19.B08.1.454.CMB.1.raw
  modified_base (189)..(189): a, c, t, g, unknown or other
  misc_feature (189)..(189): n is a, c, g, or t
  modified_base (264)..(264): a, c, t, g, unknown or other
  misc_feature (264)..(264): n is a, c, g, or t
  modified_base (330)..(330): a, c, t, g, unknown or other
  misc_feature (330)..(330): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgganacagagtcatcatctcttgccggcaagtcagagtgttagtatttattaaattggtatcagttacaaacgaggaanccctaagctacctgatctatgctgcatcctagttacgaagtcgggtccatacgtaaggtcagtcgntagtgatcgtaggacagtactttcactctacgacctatacgtagttacgtactaactaaccgtagtaagtattttacgactaacttactactagtaccaactagtagttaaccactaccctacgtctaccttacgttcggacggacggtaaccgtaggtacgactaagtacgaaacgtacgtggtacgtacgtacgaccgtacctagttactacgttacttacgtacccg

SEQ ID NO: 70930 - DNA, 748 bp, Homo sapiens
  misc_feature: GYAE6OF02H8BHA.3.19.B08.1.454.CMB.1.raw
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (282)..(282): a, c, t, g, unknown or other
  misc_feature (282)..(282): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtcctccatccctccctgtcctgcatcgtgtggganacagagtcatcattctnttggccggcaagtcagagttgttagttatttaatttaaattggtatctagttacaaaccgtagggaaaccncctaagtcctctacgattctatgactgcctatacccgtagtttaaacgaacggtcgggttacccagttaccgtaaggttcaggtcgtacgtaggttagtacgttcggtaaggggactaaggttatttaccacgttaccgtacctaactagttaccgtacggttaacgttaactaaccctaaacgttaacgtaaaggttaacgtttttcgaaacgtttaaacctttaaccgttaaccgttagttaaacccgtaaagtaacggttaaccgtttaaacgtaaacccctttacccccggtaccgttaacccgtttaccgttacccgttttaccggggaccgggtaaacgggtaaaccgttaagggttaccggacggtaacctttaaccgggaaaaaccgttacgttacggtaccggtaccgttacgaccggttactaaccgttacgtttcgttaccgttacttaacccgg

SEQ ID NO: 70931 - DNA, 651 bp, Homo sapiens
  misc_feature: GYAE6OF02IDHOJ.3.19.B08.1.454.CMB.1.raw
tcagagacgcactccacgaccggtgctcgatttagtgagtcagtaagggggagccagtctcagtcaggacacagcatggacatgagggtccccgctcagcctcctggggctcctgctactctggctccgagatgccagatgtgaccacccagatgacccagtctccatccctccctgtctgcatctggtgggagacaggatcatcattcgtcttggccggcaagtcagagttgttagttaatttaattaaattggtatctaagttacaaaaccgagggaaaccgtcctaagcctacctgaattctaagtcgactcgactataccgttaagttaacgtaaagggtccgggtaccctagtaacgtaaggttctaggtgtacgaggttagactcgtagggaactagttactttccacttcacaacctattacgtaaggtataccgtaactaacttaggaaagttacttttgaactaacgttaactaactgtaacaaacgtagtacggttaaccacttacccctcgtacttactaacgttcggggacgaaacggtaccgtaaggtagggaactactaaccggtaaaaacggtcgttagggtacggtacctacggtaaccctaccgtaatttccggtacgtttccgtaacttcccg

SEQ ID NO: 70932 - DNA, 983 bp, Homo sapiens
  misc_feature: GYAE6OF02G7W4W.3.19.B08.1.454.CMB.1.raw
  modified_base (213)..(213): a, c, t, g, unknown or other
  misc_feature (213)..(213): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccggnaagtcagagtgttagtatttatttaaattggtatctagttacaaaccgagggaacaccctaagctcctgactctatcgctgctatcctaagtttaacgaaaggttcggggtacccctagttacgtaaagggtttacgaagggtcgggacgtaacggttagggtaacttcgggtacggggtaacgtaaaggtttaactttttaccaacccgtttaccttacccgtaaaccctacgtttaccgttaaacgggtttaaaccgttaaccccgtttaaaacccgttaaaaccccgggtttaagggtttaaaaccgggtttttacgtttaaacccgttaaaacccgtttaaaacccgttttaaccgttttaaccggttaacccgttaaaaacccgttaaaccgggttaaaaccgggttttaaacccgggttaaaccccgtttaaaccccccgttttaaccccccgggttaaccccgttttaaccccggtttaaaaccccgggtttttaaccccgggggttttaacccggggggtaaaccccgggggttaaaacccggggttaaaaaccggggttaaccggggggtaaacggggtttaaacccgttaaaacccgggttaaaaaacccggttaaaaccggggtttaacccgggtttaaccgggggtaaccggtttaaccccgggttacccgttaaaccccggtttaaacccggtttaacccgttttacccggttttaccccgtttttacccggttaaacccccgtttttaacccccgg

SEQ ID NO: 70933 - DNA, 574 bp, Homo sapiens
  misc_feature: GYAE6OF02G0J7D.3.19.B08.1.454.CMB.1.raw
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatnagttcaaacagggaaacnccctaagctcctagatctatagctgcatccagtttacaaagtgggtaccagtcaaggttcagtggacagtggtatcgtggaacagtacttcacgtctcaccntacagtagtctacaacgtanaagttatttcgactaacgtttactacttctactaaacagtaacttacgtaacctaccccgtaccgtccttactaccgtttccggacggacggtaaccgtaagggtcggtaagtacgtaacgtaaacgtaacgttacggtacggcgttacgaccgacctagttccgtcgtttactaccttacccg

SEQ ID NO: 70934 - DNA, 734 bp, Homo sapiens
  misc_feature: GYAE6OF02H6KI1.3.19.B08.1.454.CMB.1.raw
tcagagacgcactccacgaccggtgctcgatttagtgagtcagtaagggggagccagtctcagtcaggacacagcatggacatgagggtccccgctcagctccgtggggctcctgctactctggctccgagatgccagatgtgaccacccagatgacccagtcctccatccctccctgtctgacatcgtgtaggagacagagtcatcatctcgtggccggacaagtcagagttgtttaagttatttaagtttaaagttggtaatcgtaagttacaaaacgtaagggaaacgccctaagtcctacctgatactatgactgactatcctagttaacaaggtcgggtccctagtacgtaagttcaggtcggctaaggtggacttcggagggtacgaagttacgtttctaaccgtctaccgaacctagtacgtaacggttacgttacctaaaccgtaaaccgttaggtaaaacgtttcttttacggtaaccttaaaacccgtttactttaaccgttacgtaaccgtaaaaacgtaaccggttaaacgttaacccgtaaaccccgtttaccccgtacccgtaccgtttaccttaaccggggttttccgggaaccggggtaaacggaacccgtaaggggtacgaacggtaacgttaaacccggaaactaccggttacggacggttaccctaacgggtccctaacgtaacgtttcccgtaggtttacccttgttaaccccg

SEQ ID NO: 70935 - DNA, 606 bp, Homo sapiens
  misc_feature: GYAE6OF02FZATQ.3.19.B08.1.454.CMB.1.raw
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
  modified_base (262)..(262): a, c, t, g, unknown or other
  misc_feature (262)..(262): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggcaagtcagngtgttagtattattaaatggtatcagttcaaaccaggaacnccctaagctacctgatctatcgctgcactacctagtttacaaaggttcgggtacccatcaaggttcaggtggacaggtggatcgtagggactaggtatttaccacttcctctaccatactaaggtacgtactaactaaaccgtagtaaacgttactttacgaccttaaacttacgtacttacgtaccaaacgtacggtaagtttaaccgaacttaccccgtccgtaccttaccgtaaccgttttccgggacggtacgggtaaccgaagggtagtacgtaactaaccgaaacgtacgttaggtacgtacctgtaaccacctagtaccttacggtcttacgtaccg

SEQ ID NO: 70936 - DNA, 698 bp, Homo sapiens
  misc_feature: GYAE6OF02JBLZ6.3.19.B08.1.454.CMB.1.raw
  modified_base (94)..(94): a, c, t, g, unknown or other
  misc_feature (94)..(94): n is a, c, g, or t
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (462)..(462): a, c, t, g, unknown or other
  misc_feature (462)..(462): n is a, c, g, or t
tcagagacgcactccacgaccggtgctcgatttagtgagtcagtaagggggagccagtctcagtcaggacacagcatggacatgaggtccccgntcagctcctgggctcctgctactctggctccgagatgccagatgtgacaccctagactgaccccagtcctaccatcctccctgtctgcatctgtgganacagagtcatcatctcgttgccggnaacgtcagtgtgttagttatttaatttaagttggtaactctagtttacaaaaccgtagggaaactcccctaagtcctaccgtgacttctaagtgtaccgtgcctacgtacctaaggtttaacgtaaggttcgggtacccagtacgtaaacgttcgtaggtcggccgtaaggtcggtacgtcggtacgggactaggttactttccaccttcgtacaccatacgtacgtacgtactaacgtaacgtntaaacgttcttacaccttaacgttactaccgttagcctaaacgacgttacggttaaccgtaccgttacccccgtgtacccgtccgttaaccgtttacggggacccggtaaacggggtaacccgttaagggggttacgaacgttaacgtaacccggtaaacggttaaaccgttggggtaacgtaccgtacgtaacccgtaccgttaccgttactccggttacctttaccttacccgg

SEQ ID NO: 70937 - DNA, 737 bp, Homo sapiens
  misc_feature: GYAE6OF02JMIQA.3.19.B08.1.454.CMB.1.raw
  modified_base (185)..(185): a, c, t, g, unknown or other
  misc_feature (185)..(185): n is a, c, g, or t
  modified_base (245)..(245): a, c, t, g, unknown or other
  misc_feature (245)..(245): n is a, c, g, or t
tcagagacgcactccacgaccggtgctcgatttagtgagtcagtaagggggaggccgagtctcagtcaggacacagcatggacatgagggtccccgcctcagctcctcggggctcctgctactctggctccgagatgccagatgtgacacccagactgacccagtactccactcctccctcgtcngtcatctggtcggagacgagagtctatcctattctcgttcggtccgggacaagtcaaggngttgttagttattaatttaattagttatctaagttacgaaacgtaacggaaagaccctaagacctaccgtacgtcctactacgtcgtcgtggacccctaagttcccgaaagtttttaccgaaaaggttttccggggtaaccccctaagggttccccaaaagggtttccgaaacggtttcggacgtaaggttcgaagttcggtagggactagggactttacgacttcactacctagtaccagttactactaccgtaaacctggaaacgttgtttacaccgtttaaacttacttaaccgttcgtaccaaactacggtaacgttaacccgacgtttacccccgtacgtacccttccgtaaccgtttaccggggaccgtaaccgggtaccgtaaggggtcgtacgtaagtaccgaaaaccggttcccgaaaggttaccgtaccggtacggtaccctaccgtacccgttaacgttacgtttcccttacgttaccccg

SEQ ID NO: 70938 - DNA, 540 bp, Homo sapiens
  misc_feature: GYAE6OF02GQ706.3.19.B08.1.454.CMB.1.raw
  modified_base (189)..(189): a, c, t, g, unknown or other
  misc_feature (189)..(189): n is a, c, g, or t
  modified_base (264)..(264): a, c, t, g, unknown or other
  misc_feature (264)..(264): n is a, c, g, or t
  modified_base (334)..(334): a, c, t, g, unknown or other
  misc_feature (334)..(334): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgganacagagtcatcatctctgccggcaagtcagagtgttagtatttatttaaattggtatcagttcaaacagggaaanccctaagctcctgatctatgctgcatccagttacaagtgggtccatcaagttcagtgcagtgatctgganagtattcactcctcacctatccagttagtctaacaacctgaacgtatttacgactaaacctttactactagtacaactagtaacgttaacactacccctccgtactaccttaccgtttcggacggtacggaacccgaagggttacgagtactacgaaacgtaacgtggtacggtcgtagacctaccgattcgtcgttactcgtacc

SEQ ID NO: 70939 - DNA, 594 bp, Homo sapiens
  misc_feature: GYAE6OF02HL5DM.3.19.B08.1.454.CMB.1.raw
  modified_base (214)..(214): a, c, t, g, unknown or other
  misc_feature (214)..(214): n is a, c, g, or t
  modified_base (424)..(424): a, c, t, g, unknown or other
  misc_feature (424)..(424): n is a, c, g, or t
  modified_base (574)..(574): a, c, t, g, unknown or other
  misc_feature (574)..(574): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggnaagtcagagttgttagttattttaatttaaattggttatacagttacaaaccgagggaaacgccctaagcctactgatctatgctgcatcctagtttaacaaaggtcgggtaccatactaaggttacaggtggacgtaggtggtagtcgtaggactagtacttacactctactacatctagtactactaacctaacctagtaatactttntaacctaactttacttactagtacaacagtaacttacgtaacctacccctacgtcctacgttaccgttccgggacggtaacgggtaaccgtaagggtaggacgtaacgtaaccgtaaacggtacgtaggtacgtcgtacgacgtaacctnttacgtcttaccttcttacg

SEQ ID NO: 70940 - DNA, 528 bp, Homo sapiens
  misc_feature: GYAE6OF02FRV2N.3.19.B08.1.454.CMB.1.raw
  modified_base (190)..(190): a, c, t, g, unknown or other
  misc_feature (190)..(190): n is a, c, g, or t
  modified_base (480)..(480): a, c, t, g, unknown or other
  misc_feature (480)..(480): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttacaaaccaggaaacgcccctaagctcctgatctatgctgcatccagtttaacaagtcgggtccatcaaggttcagtggcagtggatcgtgggacagtatttcacttctcaccatcagtagtctacaacctagtaagtatttcgactaacttactactatacaacagtaagttacaactacccctccgcctctaccgtttcggacggacggaaccaagggtacgganacgtacgaaacgtaactcggtcgctagacacctatctgtcttctaccg

SEQ ID NO: 70941 - DNA, 648 bp, Homo sapiens
  misc_feature: GYAE6OF02IFIEE.3.19.B08.1.454.CMB.1.raw
  modified_base (406)..(406): a, c, t, g, unknown or other
  misc_feature (406)..(406): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtagggagacagagtcatcatctctggcggacaagtcaggagttgttagttaatttaagtttaaattggtatctagttacaaaaccgagggaaacgcccctaaagtcctaccgtgactactatcgacttgacattacctaagtttaacgaaacgggtcgggttacccaatacgtaaaggttccgaaggttcgacgtagtggtactacgagggactaagttntttacgacctcgtacacctatcgtaagtacgtactaacaaccgtagtaattaactttgacttaaacttacttaacgtactaaccaatacgtacgttaacgaccttacccgtccgtacttaccgttacgtttacgggaccggaaacggtaacgtaagggtacggataacgtacgtaaaacggaccttagggtacgaccgttacgaccgttaacccgtattacgttccgttacttacccgtacc

SEQ ID NO: 70942 - DNA, 548 bp, Homo sapiens
  misc_feature: GYAE6OF02G8CKF.3.19.B08.1.454.CMB.1.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtggganacagagtcatcatctcttggccgggnaagtcagtagtgttagtattttatttaaattggtatcagttacaaacagggaaacncccctaagctcctgatctatgctgcactcctagtttcggntaaggtcggggtcccagtcgaaggttcagcggcaggtcggatcgtagggacagtaacttcacgtctaccacatcagcacgcctgacagcctagtattgtattttcgactaactttatactcgacctaaatagtaactaacgtacccgagttaggtaccgttcggaccgaagggaccgtaggtaggacgtactacgaacttacggaactcggtacgcctacgacctacagttccg

SEQ ID NO: 70943 - DNA, 587 bp, Homo sapiens
  misc_feature: GYAE6OF02F5HGW.3.19.B08.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
  modified_base (534)..(534): a, c, t, g, unknown or other
  misc_feature (534)..(534): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatcgtgtggganacagagtcatcatctcttgccggnaagtcagagttgttagtatttatttaattggtatcagttacaaacgagggaacnccctaagcctcctagactctaatcgcgtgcaacttccgtaagttttaacgaaaaggtttccggggtaccctaagtacgtaaaggtttaccaaggttgggactaggttaggtagttacgtagggaactagtactttccacttcctacacctatacgagtactactaacaactgaacgttatttgacttaacttacgtatacgtacaacgatacgttacacctaccctcgcttcgtacgtttcggacggtaggaccgaaggtcgganagtacgaaacgtacgttgacggctacgaccacgtatcgtacgttactctaccg

SEQ ID NO: 70944 - DNA, 557 bp, Homo sapiens
  misc_feature: GYAE6OF02GA519.3.19.B08.1.454.CMB.1.raw
  modified_base (270)..(270): a, c, t, g, unknown or other
  misc_feature (270)..(270): n is a, c, g, or t
  modified_base (551)..(551): a, c, t, g, unknown or other
  misc_feature (551)..(551): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttacaaaccgagggaaacncccctaagctcctgatctatgctgcatcctagtttaacaaggtcgggtacccagtcaaggttcagtggcagtggatcgtaggacagtattcactctcacctatcgagttagtacctaacgaacctagtaacttagtttcacttaactttactactgtaaccaactagtacgttaaccgacttaccccgtaccgcctactacgtttccgggacggtacggaaccgagggtgagactacgaaacgtacgtggtcgactagacctacgtctacgttctaccttntacccg

SEQ ID NO: 70945 - DNA, 555 bp, Homo sapiens
  misc_feature: GYAE6OF02ICH4O.3.19.B08.1.454.CMB.1.raw
  modified_base (191)..(191): a, c, t, g, unknown or other
  misc_feature (191)..(191): n is a, c, g, or t
  modified_base (267)..(267): a, c, t, g, unknown or other
  misc_feature (267)..(267): n is a, c, g, or t
  modified_base (365)..(365): a, c, t, g, unknown or other
  misc_feature (365)..(365): n is a, c, g, or t
  modified_base (452)..(452): a, c, t, g, unknown or other
  misc_feature (452)..(452): n is a, c, g, or t
  modified_base (534)..(534): a, c, t, g, unknown or other
  misc_feature (534)..(534): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccgggcaagtcagagtgttagtatttaattaaattggtatcattcaaacaggaaanccctaagctctgatctatgctgcatctagttacgaagtcgggtaccatacaagttcagtgcagtggatcgtggactagtatttcgacttctcaacctnacgagttagtctaacaacgttagaagtattttagacctaaactttactacttactacaaacgtcgtaaggttaacacgttaaccccnccgtacctaccttacgtttccgggacgggaagggtaaccgtaaggtcgaagtactacgtaaacggaccttggtcgctcgacnctattctacgttctactaccg

SEQ ID NO: 70946 - DNA, 593 bp, Homo sapiens
  misc_feature: GYAE6OF02HW6YV.3.19.B08.1.454.CMB.1.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctctggccggnaagtcagagtgttagtatttaatttaaagttgtatctagttacaaacagggaaacnccctaagcctacngtatctatgctncatcctagtttaacaaggtcgggtacccagtactaaggttacagtcggcagtggatcgtaggactagtacttcacgtctaccaactatctaagtactactactaactagaattatttagactaacttactactagtaactaacagtaagttaacgaccttaccccgtcgtaccttactaccgtttaccgggacgggtaacgggaaccgtaagggtacggtacgtacgtaaccgtaaacggtaaccgtggtacggtacctacgaccgtacctaacgttcctacgttccttacgtaccc

SEQ ID NO: 70947 - DNA, 651 bp, Homo sapiens
  misc_feature: GYAE6OF02I9HEH.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggacaagtcgagtagtgttagttatttatttaaattggtatctagttacaaaccagggaaacgacccctaagccttacctgactctatgctgcactcctagtttaagaaacggtggggtaccccagttaccgtaaggttccaggttcggactaggtaggtaactcgtaggggaacagtactttccgaacttctcctaactactacacgttaactctacaaaccttagtaagttacttttcgactaactttactacgttgtaccactaagtacgttaaccgtaccttaccccgtccgtaccttaccgaccgttttaccggggaccggtaaccgggtaaccgtaacgggtaggtaacgtacgtaaccgaaaaccggtaacttcgggtacggacctacggacctaaccgtacgttccgttacgttcccgttacttaacccgg

SEQ ID NO: 70948 - DNA, 664 bp, Homo sapiens
  misc_feature: GYAE6OF02ISPWY.3.19.B08.1.454.CMB.1.raw
  modified_base (271)..(271): a, c, t, g, unknown or other
  misc_feature (271)..(271): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttggccggcaagtcagagtgttagtatttatttaaattggtatctagttacaaacgagggaacnccctaagcctctgatctatgctgcactactagtttaacgaaaggttcgggtaccctagtacgtaaggttcgaggtggactagtaggtatcggtagggactagtactttcacttctaccactatcgtaacgttacgtacctaacgaacctagtaacgttagttttacgaacgttaaacctttaactaacgttacgtaacctaaacgtacgtaacgttaaccgtaacccgtttacccccgttacccgtaccttaccgttaaccggtttaccgggaccgggtaaccgggtaaccggtaagggtacgggtacgtaacgtaaccgaaaaccggtaacgtggtacggtaccgtacgaaccgtaccgttaacgttccgttacgttccttacgttaccccg

SEQ ID NO: 70949 - DNA, 634 bp, Homo sapiens
  misc_feature: GYAE6OF02HWWIC.3.19.B08.1.454.CMB.1.raw
  modified_base (196)..(196): a, c, t, g, unknown or other
  misc_feature (196)..(196): n is a, c, g, or t
  modified_base (616)..(616): a, c, t, g, unknown or other
  misc_feature (616)..(616): n is a, c, g, or t
  modified_base (621)..(621): a, c, t, g, unknown or other
  misc_feature (621)..(621): n is a, c, g, or t
tcagagacgcactccacgaccggtgctcgatttagtgagtcagtaagggggagccagtctcagtcaggacacagcatggacatgagggtccccgctcacgctccgtgggctcctgctactctggctccgagatgccagatgtgaccacccagatcgacccagtcctccatccctccctgtctgcatctggtggganaccaggatcatctatctcttcggccggacaagtcagtacgttgtttagttatttaatttaattggtatacgtacgttacaaacgtaagggtaaacgacccctaagactacctacgtatctaacgtcgtctagtacctactacctaagttaacgaaggttccgggtacctagtacgtaacggttactaggtcggtacgaggttagtacgtacgtacgggtactaaggttacttactacgtctaaccgtactacgtacgtatacgttacctaaccaacgttagtaagttactttcgacttaaacgttactatcgttaacaacgtagtaccttaacgtaacctaccctcgtacctacgtacgttcgggacggacgtaacgaggtcgacgtactaacgacgtacgtagtcgtcgacacaccgtntcgtnttccgtactaccg

SEQ ID NO: 70950 - DNA, 531 bp, Homo sapiens
  misc_feature: GYAE6OF02GPBY2.3.19.B08.1.454.CMB.1.raw
  modified_base (410)..(410): a, c, t, g, unknown or other
  misc_feature (410)..(410): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttacaaaccagggaaacgcccctaaagctcctgatctatgctgcatccagttaacaagtgggtccatcaaggttcagtgctagtggtatcgtgggacagtattcactctcaccatcagtacgtctacactgaaagtatttcgactaacttactactntacaaactagtagttacgtactaccctccgtctcctacgttcgacggtaggaccaaggtgagtactacgaaacgtacgtgtacggtactacggacctaccgattcgttacgttctacttac

SEQ ID NO: 70951 - DNA, 749 bp, Homo sapiens
  misc_feature: GYAE6OF02F60L6.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctgctccgagatgccagatgtgacacccagatcgacccagtcctccatccctccctgtctgcattcgtggtgggagacagagtcatcatctctcggccggacaagtcagtagttgttagttatttaatttaaattggtatactaagttacaaacgagggaacgtaccctaagcctccgtagtacttactagtcgctcgactactcctaagttaacgaacggttcgggtacctagtacgtaacggttacgagggccggacgtaggttaggtacgtacggtagggaactaaggttaacgttacctacgttaccctaccgtaacctaactcgtaacgtaccgtccggtactaccggtaccgtaaaccgtcccgttagtaaccgtttagggtttacttttaccgtaaacctttaaaccttttaccgtttaacccgttacgtaaaccccgttaaagttaaaccgtttaacgtttaaaccccggttaaccggtacccggtttaacgttacccgggttaacccgggtaaccggtaaaaccggggtcgtaaacggggtcggtaaacgtaacggttaaccgtaaacggttacccggtaaagtcgggttacgtctaccgacctacctagtccttacccgg

SEQ ID NO: 70952 - DNA, 637 bp, Homo sapiens
  misc_feature: GYAE6OF02IQEHN.3.19.B08.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (274)..(274): a, c, t, g, unknown or other
  misc_feature (274)..(274): n is a, c, g, or t
  modified_base (629)..(629): a, c, t, g, unknown or other
  misc_feature (629)..(629): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctctggccggnaagtcagagtnttagtatttatttaaattggtatntagttacaaaccgtagggaaacncccctaagctcctagatctatgactgcactcctaagtttaacaaaggtcgggtccatacgtaaaggttcagtgtcagtggatcgtaggacaagttacgttcacgtcttacaacctatactaagttacgttacctaacgtaaccgtagaaagttatttagaaccgttaaactttacttaaccgttacgtaaccaaactaagtaacggtttaaccaacttaacccccgtccgttacctacgttaccgttttcggggaccggtaacggtaacccgtaagggttcgaacgtaacgttaaccggaaaccgtactacgggtcggactacgaccgtaccaacgtttccgtacgttaccgttnttaacccg

SEQ ID NO: 70953 - DNA, 642 bp, Homo sapiens
  misc_feature: GYAE6OF02I7NQ7.3.19.B08.1.454.CMB.1.raw
  modified_base (190)..(190): a, c, t, g, unknown or other
  misc_feature (190)..(190): n is a, c, g, or t
  modified_base (279)..(279): a, c, t, g, unknown or other
  misc_feature (279)..(279): n is a, c, g, or t
  modified_base (373)..(373): a, c, t, g, unknown or other
  misc_feature (373)..(373): n is a, c, g, or t
  modified_base (603)..(603): a, c, t, g, unknown or other
  misc_feature (603)..(603): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcgttcggccgggctaagtcaggtagtgttagttatttatttaaattggtatctagttacaaaccaggggaaacnccccgtaagcctcctgattctagtgctgacatcctagttaacaaggtcgggtaccagtacaaggttcaggtcgacaggtggacttcggtggtanaagtactttcgacttctacacgtatacgagttacgtactaacaaccgttagaaagtttacttttcgaacttaaacgtttactaacttcgtacaaaccttaggtaacgtttaacccgacccttacccccgttaccgacccgttacctacggtttcccggggaagggtaccggaaccgttaggggtacgacgtaacgtaaccgaaacgttacggttcggtacggaccgttanacccgacccgttaagtcccgttagttcttacccgtcccg

SEQ ID NO: 70954 - DNA, 630 bp, Homo sapiens
  misc_feature: GYAE6OF02HG4R8.3.19.B08.1.454.CMB.1.raw
  modified_base (267)..(267): a, c, t, g, unknown or other
  misc_feature (267)..(267): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtcctccatcctccctgtctgcatctgtgggagacagagtcatcatctcttggccggcaagtcagagtgttagtatttatttaattgtatcagttacaaacgaggaacnccctaagcctacctagactctatcgtctcgactactacctacgtttaacgaaacggtcggggtaccccagttacctaaggttcgaaggtcggtactaggtcggtagtcgtagggaactagtatttcacctctacctaaccatcgtaacgtacgtactaacctaacctagtaacgttatttacggacttaacgtttacctaacttacgttaaccaactacggtaacgtttaaccgaccgttaacccccgtacgttcctaccgttaccgtttccgggaccgggtacggaaccgtaagggtcggagtactaccggaaacgtactacggtacgacgttcgactaccgtattcctgttcctactaccg

SEQ ID NO: 70955 - DNA, 735 bp, Homo sapiens
  misc_feature: GYAE6OF02J054R.3.19.B08.1.454.CMB.1.raw
  modified_base (130)..(130): a, c, t, g, unknown or other
  misc_feature (130)..(130): n is a, c, g, or t
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
tcagagacgcactccacgaccggtgctcgatttagtgagtcagtaaggggagccagtctcagtcaggacacagcatggacatgagggtcccgctcagctcctggggctcctgctactctggctccgaggntgccagatgtcgaccacccagactgacccagtctccatcctccctgtctgcactctggtgggacacncgagtcatcactctcgtgccggnaacgtcgaagtgttgttagtatttatttaaatggtatctagttacaaacgtaacgggaaacgtcccctaacggtactccgtagactactaacgtgcctttagcctacttaccctaagttttaaccgtaaacggtcgggttacccctacgtacgttaaggttaccgtagttacgggctaaggtcgggtacttacggtacggaacgttacggtagtttttaccaccgttattacccaaccgtaatccgtaacggttaacgtaccttaaccgtaaaccttaggttaaacgttacgttttacgtaaccttaaaccgtttacgttaaccttaggtaccgtaactaaggttaaccgttacgtacccgttaccgtacccgtcctacggttaccgttaccgggtacggtaacccgggtactaaacggggttcgaacgtataacccgaaaacggtactttaacgggtacgtcccgttacgaaccttacccgtagttaccgtttcggttacctccgtttaacccg

SEQ ID NO: 70956 - DNA, 586 bp, Homo sapiens
  misc_feature: GYAE6OF02GTUTB.3.19.B08.1.454.CMB.1.raw
  modified_base (279)..(279): a, c, t, g, unknown or other
  misc_feature (279)..(279): n is a, c, g, or t
  modified_base (359)..(359): a, c, t, g, unknown or other
  misc_feature (359)..(359): n is a, c, g, or t
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (473)..(473): a, c, t, g, unknown or other
  misc_feature (473)..(473): n is a, c, g, or t
  modified_base (555)..(555): a, c, t, g, unknown or other
  misc_feature (555)..(555): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtctccatccctccctgtctgccatcgtggtgggacgtacagagtcaatcattctcgttggccggcaagtcagtgtgttaagttatttaattaattgtatcgtattacaaacgaggaacnccctaagtctccagagttctaatcgctgctatcctaagtttaacaggttccggtccaatcgtaagtcgagtggctaggtnacgtgtcggaactagttacttcgactctacacanctagtacnctaacacgtagtaacttattacgcttaaacttcgttaactcgactaagacttacgagtaaccctcctccgtntaccgtaacgtttcgggaaccgggacgtacgggacgtagaacgttaccgaacgtaacgtacgtcgtaccgtagtccggaccnccgttaagtacctttcgtacgttacctaccg

SEQ ID NO: 70957 - DNA, 846 bp, Homo sapiens
  misc_feature: GYAE6OF02F6EZK.3.19.B08.1.454.CMB.1.raw
  modified_base (191)..(191): a, c, t, g, unknown or other
  misc_feature (191)..(191): n is a, c, g, or t
  modified_base (208)..(208): a, c, t, g, unknown or other
  misc_feature (208)..(208): n is a, c, g, or t
tcagagacgcactccacgaccggtgctcgatttagtgagtcagtaagggggaggccagtctcagtcaggacacagcatggacatgagggtccccgctcagctcctggggctcctgctactctggctccgagatgccagatgtgacacccagatgacccagtctccatcctccctgtctgcatctgtggganacagagtcaatcatctnttgccgggcaagtcagagtgttagtatttattaatgtatctattacaaacaggaaactcccctaaagctcctagtaactccttaatcgcgttcacgtactaccgtaaggtttaacaaaacggggttccggggttacccctaagttaccgtaaacggggtttaccgtaagggttcgggtacgtaggttaggtacttaccgggttagggaaacgtagttaacgttttccaacgtttcctaccgtaacccgtaagttaccgtaaaggttacgttacctaaaccgttaaaccgttaaggtaaacgttaacgtttttacgaacctttaaaccgtttaacgttaaccttagttaaccgtaaacgtaacggttaaaccggttttaaacccgtaaacccttaaccccccggttacccgttaaccgtttacccgtttaacccgggttttacccggggaaacccgggttaaacgggggtaaaacccgtaacgggggttaacggtaaccgggtaaaccgttaaaccgggaaaaaacccggttaccggttaccggggttaaccgggttccgttaaaccccggttaccctaacccgggttaacgtttaaccccggttccggtttttaaaccgtaacccgttttaaccccgg

SEQ ID NO: 70958 - DNA, 706 bp, Homo sapiens
  misc_feature: GYAE6OF02IUC8Z.3.19.B08.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (277)..(277): a, c, t, g, unknown or other
  misc_feature (277)..(277): n is a, c, g, or t
  modified_base (697)..(697): a, c, t, g, unknown or other
  misc_feature (697)..(697): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtcctccatcctccctgtctgcatctgtggganacagagtcatcatctctggccggnaagtcagtagtgttagtattttaattaaagttggtatcgtagttacaaaaccgagggaaacncccctaagcctcctagatctatgctgacatacctagtttaacaaagggttccgggtacctaagttacgtaaaggttccgaaggtcggtaccgtaggtaggtacgtcggtagggaactaggttactttaccgacgttacctccgaacctacgttacgtaaggttacgttaacccttaaccgtaacccgttaaggtaaacgttacgttttaggaacccttaaacgttttacccgttaacttacgttaaaccaaacgtagttaaccggttaacccgtaacccttacccccgttacgtcccttaacgttacccggtttcggggaaccggtacgggtaacccgtagggtacggaagtaacgtaaccggaaaacgtacgttgggtacggtcgtacgtaccaaccgttcgttccgtatttacccgtnttaaccccg

SEQ ID NO: 70959 - DNA, 738 bp, Homo sapiens
  misc_feature: GYAE6OF02J2KFG.3.19.B08.1.454.CMB.1.raw
  modified_base (622)..(622): a, c, t, g, unknown or other
  misc_feature (622)..(622): n is a, c, g, or t
  modified_base (687)..(687): a, c, t, g, unknown or other
  misc_feature (687)..(687): n is a, c, g, or t
tcagagacgcactccacgaccggtgctcgatttagtgagtcagtaagggggagccagtctcagtcaggacacagcatggacatgagggtccccgctcagctcctgggctcctgctactctggctccgagatgccagatgtcgaccacccagatcgacccagtctccactccctccctgtctgctactcgtggtggagacagacgtcatcgattcctcgttacgccggctaagtcaaggtacgttgttaagtttactttaatttaaacttggtactcgtaacgttaccgaaaccgaaggtaaaccgtccctaagccttaccgtgacttctattcgacctgtacctaagtccgttaaagttacggaaaccggttcgggtaccctaggtcccgttaaacgggttcgacggttacggtacgtaggttaggaccgtttacgggtacgggtaacttacgtttaacgtttcctacctaccttacctaaccgaacgtttacgaacggttttaacctaaccctaaaccggttaaaaccgttgttaaacggtttacctttaacctaaccgttaactttaaaccgtccgtagtaaccaacgtacgttacccgttaacacccttaccccgtacncgttacccggttacggttacgggcgtaacgaacggtacgtaacgcaaaccgttcgaaaccggttncggtacgtacgcgtaacaccgttcttccggttacgtaccttcgtaaccccg

SEQ ID NO: 70960 - DNA, 715 bp, Homo sapiens
  misc_feature: GYAE6OF02JYJN5.3.19.B08.1.454.CMB.1.raw
  modified_base (160)..(160): a, c, t, g, unknown or other
  misc_feature (160)..(160): n is a, c, g, or t
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
tcagagacgcactccacgaccggtgctcgatttagtgagtcagtaagggggagccagtctcagtcaggacacagcatggacatgagggtccccgctcagctccgtgggctcctgctactctggctccgagatcgccagatgtgaccacccagatgacccngtcctccactcctcctgtctgcntcgtaggngggacacgagtcgtcactactcttcgttgtccggccggtacaaagttcgagttagttagtttagtttaattttaagtttaaagttcggttatctaacttaacgaaaccggaagggtaaacccncccgtaacgtntacccgtgtaacttctagtgactcgtacttaccgaacgtttaggtaacccgtaaggggttcccgaaccgttacaaacggttacggtcgaagggttccggaagtttggaaggtacttacgggtacgtaatacggtttaccttaccacgtttaccacgtaccgtatacgtaacgtacgttaacgtaacccgtagttaacgtatttacgttacgtaccttaattacctttaacgagtaacctagtacgttaaccgtaccgtaaccttacccctacgtccgtaacgttaccggttaacggacggttacggaacgtacggtacgtagtacctaacggtaacgtacgtacggtgtacgtaccacttacgtccttagttaccgttcctaccgttccc

SEQ ID NO: 70961 - DNA, 687 bp, Homo sapiens
  misc_feature: GYAE6OF02IGDIT.3.19.B08.1.454.CMB.1.raw
  modified_base (94)..(94): a, c, t, g, unknown or other
  misc_feature (94)..(94): n is a, c, g, or t
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (280)..(280): a, c, t, g, unknown or other
  misc_feature (280)..(280): n is a, c, g, or t
tcagagacgcactccacgaccggtgctcgatttagtgagtcagtaagggggagccagtctcagtcaggacacagcatggacatgagggtccccntcagctcctggggctcctgctactctggctccgagatgccagatgtgaccacccagatcgacccagtcctccatccctccctgtcctgctatctggtggganacgagatcatcactctcgtcggccgganacgtcaggtagtagttattatttaattaaattggtatcgtatacaaacgaggaacncccctagcctactacgtacttacgtaatcgctgacacttacctaagtttaacgaaggtccgggtaccagttacgtacggttacaggtcggactaggtacgacgttacggtagggtaactagttactttaccgacttacgtaccctaacgtactacgtaacgtagttaccctaaccgtaacgttagtaacgttagtttaccgaacctttaaaccttaccgttaacgtaccgtaacctaaacgtacggttaaccttaacgtaccccgttaaccccgtacgtcccttacgtttacccggttcgggtaaccgggacgtaaccgggtagacggtacgaacgtaaccgtaaacggtacgtcggtaacgtccgtaagaccctacgtaccgtttcaccgtttctaaccttccccg

SEQ ID NO: 70962 - DNA, 565 bp, Homo sapiens
  misc_feature: GYAE6OF02FMA0B.3.19.B08.1.454.CMB.1.raw
  modified_base (266)..(266): a, c, t, g, unknown or other
  misc_feature (266)..(266): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (390)..(390): a, c, t, g, unknown or other
  misc_feature (390)..(390): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttcgccggcaagtcagagtgttagtatttattaaattggtatcagttcaaacaggaaacnccctaagctcctgactctaatgctgactactcctaagtttaacaaagggttcgggtaccccatacgtaacggttcaggtcggcagtggactcgaggacagtnttacnctcacactatcgtagtntctaacactagaagttatttcacttaacttatactagtacaacgtagtagttaaccacctacccctccgtaccttccgtacgtttccgggacggtacggaccgtaaggtcgacgacgtaacggaaactacgtggtacgacgtagacctacgtacgttccttacgttacctctacc

SEQ ID NO: 70963 - DNA, 704 bp, Homo sapiens
  misc_feature: GYAE6OF02F8N9A.3.19.B08.1.454.CMB.1.raw
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (686)..(686): a, c, t, g, unknown or other
  misc_feature (686)..(686): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctcctgtctgcatctgtggganacagngtnatcatctctggccggntaagtcagngttagttagttatttattaattgtatnattacaacgaggaacncctaagtctcctagtatcgtatgactgactactacctagtttaacaaaggttccgggtaccctagtactaaggttactaggttacggactaggttacggtaagttcggttacgggaactaagggttactttaccgaacttccgtaccgaactacgtacgtaacggttacgttacctaaaccgtaacttacgtaaagtttacgttttacgaccttaaaaccgtttctaacgttctaaccgtaaacgtaagttaacgtttaacctaacccgttaccccgttccgttaccctaccgtttaaccggtttaccggggtaccgggtaaaccggtaacgggtaaacggtacggtaagaaccgttaacggtaaaaccgtaacggttacggttcggttaacgacgtacccaacggttactacccggtttnttaccgtacttaacccgg

SEQ ID NO: 70964 - DNA, 709 bp, Homo sapiens
  misc_feature: GYAE6OF02GRW4N.3.19.B08.1.454.CMB.1.raw
  modified_base (189)..(189): a, c, t, g, unknown or other
  misc_feature (189)..(189): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgaggatgccagatgtgaccacccagatgacccagtcctccatccctccctgtctgcatctgnggancagngtcatcatctctggccggntagcagtagtgttagtatttatttaaattggtatntagttacaacgtaggaacgccctaagctacctagactntatgtctcacgtactaccgtaagtttaacgaacggttcggggtaccctaagttaccgtaaagttcggtacggtcggtacgtagggttaggacgttcggtacggggaactacggtaacttttaccgtaactacccgttactaacccgtattaccgtaagtaacgttaccttaaaccgtaaccttagggtaaacttaagttttacgaacctttaactttaaccgttacttacgttaaaccaacgttaacggttaaaccgttaaccgttaaacccgtaccccgttacccgtacctttaaccgttaaccgggtttcccggaaccggggtacggaaacccggtaggttacggacgtaacgtaacggtaaaccgtagttacgtcggtactacgtacgtccctagttcgtcttaccgtacttacccg

SEQ ID NO: 70965 - DNA, 642 bp, Homo sapiens
  misc_feature: GYAE6OF02JNKCL.3.19.B08.1.454.CMB.1.raw
  modified_base (151)..(151): a, c, t, g, unknown or other
  misc_feature (151)..(151): n is a, c, g, or t
  modified_base (159)..(159): a, c, t, g, unknown or other
  misc_feature (159)..(159): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagntcgacccngtctccatcctccctgtctgcatctgngganacagatcatcatctcttggccggctaagtcagtgtgtttaagtatttatttaaatggtatctacgttacaaacgaggtaaacgtccctaaagtctcctagactctatgctgctactactaagtttacgaaacggtcgggtacacttacgaaggttcgaaggtggtacaggtcgtaagtcggtaggtaacgtacgtactttacaccgttactacctaacggataccgtaagtacgttaccgtaactaaccgtagtaagttactttacgacgttaacctttacttaacgtgttaaccaaacgttagttaacgttacccgaccctttaaccccgtccgtacttacgtttaccgtcgggtaaccgggtacgtaacgtaggtacgtacgactaccgtaaaacggtcttacggtgcgttacaccgtaccgtaattaccgtcgttacgttactacccgg

SEQ ID NO: 70966 - DNA, 791 bp, Homo sapiens
  misc_feature: GYAE6OF02HG45N.3.19.B08.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatcgacccagtctccactcctccctgtctgcatctgtggganacagtacgtnatctatcctcgttcggccgggactaagtcgaaggtagttagttaagttaattttaagtttaaattggttaatacgtagttaaccgaaaaccgtaagggaaaccgaccccgtaagtccttaccgtagtacttacttatcgtcgtgcctaacttccgttaagtttaacgaacggttccgggtaaccctagttacgtaggtttacagggtcgacgtaggtggtacttccggtagggtaactacggtttacttaccgacctttcgtacctaacctacgtaaccgttaaggttaacgttaaccgttaaaccgtaaaccgtttaagtaaacggtttaactttacggtaaaccctttaaaccgtttaacccgtttacgttaaccgttaacggtaaaaccgttagggttaaccgtttaacccgtaacccctttaacccccggttccgtaccgttaccggtttacccgtttaaccgggggaacccggtaccgggtaaacggtaaacggggttaggacgtaacggttaaccgtaaaacggtacgttacgggtacgttacgacgtaccctacgtacttcggttacttacctcgtacccg

SEQ ID NO: 70967 - DNA, 785 bp, Homo sapiens
  misc_feature: GYAE6OF02IMZK0.3.19.B08.1.454.CMB.1.raw
  modified_base (200)..(200): a, c, t, g, unknown or other
  misc_feature (200)..(200): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatcgacccagtcctccacttccctcccgtgtctgctatcgtggtggganacgagagtcatcactcttcgttcggaccgggacaaggtcgtaggtacggtttagttaagtttaattttaatttaaagttggttattacgtagttaaccaaaccggaagggtaaacctccccgttaagtcccttccgtagtacttacttagtcgtactagtacctacgttaccgttaacggtttaacgaacgggttccgggtaaccctaagttaaccggttaagggttccgagggttacggacgtaggttcggaacgttcggtacgggtactaaggttcttttaaccgccttacctactacctacgtacgttaagttaccgttaccgtaaacccttacggttaagtaacgtttacgtttacgtaaacccttaaacgttttaccgtaacttaccgtaaccgttaaacgtacggttaaaccggtttaccctacccgttaccccttaccgaccttacccggttacgggttaccggggaaacggtaaccgggtaccgtaaggtacggaccgtaaacgtaccgggaaaaccgttcggcgtacgggtacccaggtcccctaagttcgtcctttacggtcttaccgtaccccg

SEQ ID NO: 70968 - DNA, 939 bp, Homo sapiens
  misc_feature: GYAE6OF02JRTS6.3.19.B08.1.454.CMB.1.raw
  modified_base (131)..(131): a, c, t, g, unknown or other
  misc_feature (131)..(131): n is a, c, g, or t
  modified_base (225)..(225): a, c, t, g, unknown or other
  misc_feature (225)..(225): n is a, c, g, or t
  modified_base (242)..(242): a, c, t, g, unknown or other
  misc_feature (242)..(242): n is a, c, g, or t
tcagagacgcactccacgaccggtgctcgatttagtgagtcagtaagggggaggccgagtctcagtcaggacacagcatggacatgagggtccccgctcagctcctgggctcctgctactctgctccgagntgccagatgtcgacacccagtatcgacccagtcctccactccgtccctgtctagcacttctggtcggagacagagttccaacttcactttaccncgttcggacccggggtnaaacgggttaccaagggtacgttacgttttaaggtttaacgttttttaatttttaaaaggtttcgggttaatttaccgttaacggtttaacccctaaaaccgggttaaccggggaaaaccggttaccccccgttaaagccccgtttaccgttaccggtaacttcccgttaatccggtaccttacgggtacctaacgttacccgtttaaaacggttttaacccgtaaacgggggttcccgggttaaccccggtaattaccggttaaaccgggtttaccaggggttacgtaccggtagggtttaacgggtactttacgggttaacgggggacctttaaacggttacggtttttaacccaaccgtttcccttaaccgtaaacccgttagttaactaacggttaccgttaaccgtaaaccgttaaccgttaacgttaaacgggtttacgttttaccggtttaaccgttaaccgtttaaaccgttaaccgtttacggtaaaccctaaacgttaacgggtaacgttttaaaccggtaacccttaaccccgttaccgtaccttacccggttcgttttaaccggggacggttaacccggtaacgtacgggtaggtaccgtacgtaacccggtaaacggttaaccgtaggttaccggtacgtaccgtaccgtaacgtacgttacgttcctttaccgttactacccg

SEQ ID NO: 70969 - DNA, 712 bp, Homo sapiens
  misc_feature: GYAE6OF02F0JC7.3.19.B08.1.454.CMB.1.raw
  modified_base (299)..(299): a, c, t, g, unknown or other
  misc_feature (299)..(299): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatgacccagtctccatccctccctgtctgcatctggtagggagacagagtcatcatcttcgttcggccgggacaagtcaaggtagttgttaagttattttaatttaaagtttggtattcgtagttaccaaaaccgtaaggggaaaccnccccgtaagtctacctagactctatgctgctactctaagtttacaagggtcggtaccagttacgtaagttcgaaggtggacgtaggttaggactcggtaggaactagttacttcacttcgacactactactagttaactccttaaacgacctagtaaacgttagttttaacgaccttaaaccgtttaactaccttaacgtaacctaaacgtacggttaaccggttaacccgtacccgttaaccccccttgaacccgtttaccgttaccgggtttaccgggtaaccgggtaaacccggggtaacgtagggtaacgggtacgtaacgttaaccggaaacggttaacggttcgggtaacggtaccgtacgtaccgtaacccgtagttaccgtacgtttacccgttaccttaacccg

SEQ ID NO: 70970 - DNA, 585 bp, Homo sapiens
  misc_feature: GYAE6OF02FRQID.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttacaaacgagggaacaccctaagctcctgatctatcgctgcatcctaagtttacaaaggttcgggacccaagtactaaggttcagtcggactaggtagagtcgtgggactaggtactttcacttcctacacctactactagttactactaccgtaaacctagtaacgttaattttacgacttaaaccttacttaacttactaacaactaacgtacgttaactaaccttaccccgttcccgacttactaccgtttcggaccggtaggaaccgtaagggtcgagactacgaaacggtacgtaggtagctagacaccgtatctgttccttataccg

SEQ ID NO: 70971 - DNA, 672 bp, Homo sapiens
  misc_feature: GYAE6OF02GQ35H.3.19.B08.1.454.CMB.1.raw
  modified_base (122)..(122): a, c, t, g, unknown or other
  misc_feature (122)..(122): n is a, c, g, or t
  modified_base (213)..(213): a, c, t, g, unknown or other
  misc_feature (213)..(213): n is a, c, g, or t
  modified_base (475)..(475): a, c, t, g, unknown or other
  misc_feature (475)..(475): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
tcagagacgcactccacgaccggtgctcgatttagtgagtcagtaagggggtaggtccgagtctcacgtcaggacacagcatggacatgaggtcccgctcagctcctgggctcctgctactntgctccgagtatgccagtactgtgacaccagatcgacccagtctccatccctcctgtctgactattctggtgggacacagtagtccaactnacttcgttcggtacgggaccggtataacgtcgaacggtagttcgttaacgttacttttaagtttaaacgttcggtacgtacgttaacgttaaccaaacggaacgggtaaaccgaccccgttaagggtccttacccgttacggtaacttaccgtaacgttcgtaacgtcgaccgttacgtaccgtaacgtttaaacgaacgggttcgggtactaatacggtaaggttcctaagtcggtacgtaggtacgtagtcgaggaactnttacgttcacgtcacaacgtctacaagtctactacgtatacgacttactcgactactactntacgtanacgtagtacgtacgtaccttaccgtctcgtacgtacgttagggaccgtacggtaaccgagttagtaccgagtaaccgtaaacggtagtcggtagtaccgagtaccaacgttctgcgttacgtctaaccg

SEQ ID NO: 70972 - DNA, 812 bp, Homo sapiens
  misc_feature: GYAE6OF02HDW17.3.19.B08.1.454.CMB.1.raw
  modified_base (293)..(293): a, c, t, g, unknown or other
  misc_feature (293)..(293): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccactcctccctgtctgccatcgtggtgggagacagagtcatcatcttcttggcccgggacaagtcgagtagttgtttaagttattttaatttaaattggtattactaagttaccaaaacgaagggaaacncccctaaagtcctaccgtgtactctatgctgtctacgtacctaagtttaacgaacggtcgggtaccctagtacgtaacggttcaggtcggtacgtaggtaggacgttcggtacgggtaactacggttaactttccgaaccttacctacccgaaaccgtacgttaaccgttaacgttaaccggttaaccctaaaccgtaaacccggttaacgtaaacggtttacgtttttaccgaaaccctttaaaccgtttaaccgtttaaccttaacggttaaccgtaaaacgtaccgggttaacgttaaacccgttaacccgttaacccccgttacccggtaccctttaccggtttaacgggtttcccgggtaaaccgggggtaaacccgggtaaccgggtaacggggttacgggtaacgttaaaccggtaacccggtaaaaaccggttaaccggttacgggttacgggtaccgtaaccggtccgtaaccggttaccttaacggttccgtttacctaccgttacccg

SEQ ID NO: 70973 - DNA, 576 bp, Homo sapiens
  misc_feature: GYAE6OF02F5KOB.3.19.B08.1.454.CMB.1.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (258)..(258): a, c, t, g, unknown or other
  misc_feature (258)..(258): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctctgccggnaagtcagntgtatattattaatggtatcagttcaaacgaggaaacnccctaagctacctgactctatgctagcatccagtttaacaaggtcgggtccagtcaaggttcaggttgacgtagtggatcgtaggacagtattcgactcgtacactatcagtagtctaacacctagtaagtatttcgacttaactttactactataccaactagtaacgttacgaccttaccccgtccgtacttccgtacgttttccggacgggtaaccggaaccgtaagggtcggaacgtacgtaaccgaaacggttaacctgggtaaccgttcgtagacccgtaccttagttcctacgttacctttacgtaacccg

SEQ ID NO: 70974 - DNA, 727 bp, Homo sapiens
  misc_feature: GYAE6OF02HVW8Y.3.19.B08.1.454.CMB.1.raw
  modified_base (251)..(251): a, c, t, g, unknown or other
  misc_feature (251)..(251): n is a, c, g, or t
  modified_base (654)..(654): a, c, t, g, unknown or other
  misc_feature (654)..(654): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatcgccagtatgtgaaccaccctagactcggaaccccagttcccttccacttcccttacccgtgtcctggctatctgggtgggacacagtagtcatcagttccttcgtacgggccggtanaagtcagtagttgtttaagttacttttaattaagtttgtattcttaacgtaccaaaccgtaagggaaccaccctaagcctccggtatacgtactacgtgctggtaccacgtttaccgttaagtttaacgaacgggttccgggtaacctacggttacgtaacggtttcgagggttacgtcgttaacgggagtacgttaccggtagggtacttaggttaacttttacccgacttaccgttaccaacctacgttacgtagttacgtaacctaaccgtaacgttagtaacgttcttaccgaactttaactacgttactagtaccctaagaccgtaaccggttaccaacccgttacgtacccgttccgtacgttacccggttcggggaacggaccgggtaatacgggnggtaacagttaaccggaagtaccgtggaccgtatcaacccgttagcttaaccggtctttccgatttacccggg

SEQ ID NO: 70975 - DNA, 614 bp, Homo sapiens
  misc_feature: GYAE6OF02HAAVB.3.19.B08.1.454.CMB.1.raw
  modified_base (213)..(213): a, c, t, g, unknown or other
  misc_feature (213)..(213): n is a, c, g, or t
  modified_base (263)..(263): a, c, t, g, unknown or other
  misc_feature (263)..(263): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatccctcctgtctgcatctgtggagacagagtcatcatctcttgccggnaagtcagagtgttagtatttattaattgtatcagttacaaacaggaaacnccctaagcctcctagatctatgctgacatctagttacaaaggttcgggtacctagtacaaggttcagtaggctaggtggtatcgtagggactagtacttcacttctacaacctatacaagttagtacctaacgtaactagaagtatttacgacttaacgttactacgttagtacctaacgtagtaacgttactaaccttaacccccgtcgtaccttaccgtaccggtttaccgggaccgggtaaacggtaacccggtaagggtacggtaacgtacgttaaccggaaaaccgttacgtaggtaccggcttacgaccttaccgtagttccgtacgtttaccctacttaacccg

SEQ ID NO: 70976 - DNA, 722 bp, Homo sapiens
  misc_feature: GYAE6OF02JXKDM.3.19.B08.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (715)..(715): a, c, t, g, unknown or other
  misc_feature (715)..(715): n is a, c, g, or t
tcagagacgcactccacgaccggtgctcgatttagtgagtcagtaaggggagccagtctcagtcaggacacagcatggacatgagggtccccgctcagctcctggggctcctgctactctggctccgagatgccagatgtgacacccagatcgacccagtctccatcctccctgtctgcatctggtgganacagagtcatcatctcgttggccgganaacgtcagagttagttagtatttattaagtggtatcgtagttaccaaaccgaggaaaccgtccccctaaaggccttacccgttagtaacgttacttaacgtcgtaccgtacgtaccgtaactttaccccgttaaaggttttaaaccgaaaacgggtttccggggttaccttaaacgttacggtaaaccggtttgaacggttacggtaccgtaaggttcgggtaacgttacccggtaaggggaaccttaagttaacgtttccgaacgttaccgtacctaaccgtagtaccgtagttaacgtacctaaaccgtaaccgtagtaaaccgtttattaccggtaactaacgttacgtacgttacgtaactaaacgagtacgttaccgaaccttaccccgtactacttaccgtacgtttaccgggacggtaacggtaccgtaaggtacgacgacgttacgaaacgtacgtgtaacggctacgacctaccagttcctgttacctntaacccg

SEQ ID NO: 70977 - DNA, 810 bp, Homo sapiens
  misc_feature: GYAE6OF02IVRN7.3.19.B08.1.454.CMB.1.raw
  modified_base (197)..(197): a, c, t, g, unknown or other
  misc_feature (197)..(197): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatcgacccagtcctccactccctccctgtctgctatctggtggganacagagtcatcactcttcgtacggccggtacgggaatcgaaggtagttagtttaagttaattttaagtttaaaattcggtaattacgtaacgttaaccaaaaccgtaaggggaaacctacccccgtaaagtcccgttaccgtagacttactaagtcgtctacgtactacgttacctaagtttaacgaaacgggttccgggtacctaacgtacgtaaacggttcgtaacggtcggtacgtaaggttacggtacttacgggtacggtaactaacggtttaacttaccgtaacctcctaaccaacctaacgttacgtaaacggttaaccgtaccgttaaaccgtaacccgttaaggtaaacggtttaacttttacggtaaacccttaaacctttacgtttaaccgtaacggttaacctaaaacggtaaccgttaacgtttaaacccggtaacccttaacccccgttccgtaaccgttaccgttaaccggtttacggggaaccgggtaaccgggtaaaacccggtaaggggtaacggtacggtaaactaaccggtaaaacggtaccgttgggtacgtaccgtacgaacctacgtactcttacgttcgtaccttacgg

SEQ ID NO: 70978 - DNA, 666 bp, Homo sapiens
  misc_feature: GYAE6OF02GN1C1.3.19.B08.1.454.CMB.1.raw
  modified_base (144)..(144): a, c, t, g, unknown or other
  misc_feature (144)..(144): n is a, c, g, or t
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (442)..(442): a, c, t, g, unknown or other
  misc_feature (442)..(442): n is a, c, g, or t
  modified_base (646)..(646): a, c, t, g, unknown or other
  misc_feature (646)..(646): n is a, c, g, or t
tcagagacgcactccacgaccggtgctcgatttagtgagtcagtaagggggaggccgaggtcgtcgacgtcaggacacagcatggacagtgacgggtccccgctcagctccgtcggggcctcctgctactcgtgtcgtccgagntgccgagatgtcgacaccaagctcgacccagttcncctactcccgtcctgtctgctntcgtggtggaccgagaggtatcatcncttctcggttcgccgggtanaacgtgagtgttagttattaacgttttaattaaccgtggttataccggtattaaacccggaaacgaacgggtaacctcccccgtaatccggttccctaagtcctttaacgtggtcccttaagggcctaacgtacttacccgtttaacgttaaaacgggtcggtacgggtaccctaaggtcgtaacgtaggtcggngtacgtgtaggacgtggacgagtcgttactcacttcgactatacgtatacgtcactactagtactaagttacgtacgtactacttacgtactacgtaacgtacgtaagtaccgttacctcccgtacctccgtacttaccgtacggtacgggcggtacggaacgtagacgacgtaacgacgttaacgacgtacgtcgactcgacngttcgtactcttactctccg

SEQ ID NO: 70979 - DNA, 766 bp, Homo sapiens
  misc_feature: GYAE6OF02JMYAH.3.19.B08.1.454.CMB.1.raw
  modified_base (195)..(195): a, c, t, g, unknown or other
  misc_feature (195)..(195): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (430)..(430): a, c, t, g, unknown or other
  misc_feature (430)..(430): n is a, c, g, or t
  modified_base (733)..(733): a, c, t, g, unknown or other
  misc_feature (733)..(733): n is a, c, g, or t
tcagagacgcactccacgaccggtgctcgatttagtgagtcagtaagggggagccagtctcagtcaggacacagcatggacatgagggtccccgctcagctcctgggctcctgctactctggctccgagatcgccagatgtgacaccagatcgacccagtctaccatccctccgtgtctgctatcgtggtggganacagacgtcatcntcgtnttggccggataggtacagacgtttgtaagttacttttaagttaactggtactcgtaaggttaccaaaaccggagggtaaacctacccccgtaagtccttacgtagtactacgttaatggccttaggactaactacccgtttaaagttaacgtaaacggggttccggtaccctaggtacctaaagggttccgaagggttcgtacgaagggttggtacncgggtaacggtataacggttaacttcgacgttaccctactactacgttaacgtagtttaaccggtaccttaaaaccgtaccgtaacgttaaagtttacctttaccggttaaaccttaaacccgttttacgttacccgttaacgtaaaccctacggtaacgttaaccgttttaacccgaacccgttttaccccgaaccttacctttccggtaacccggtttaccggggacggtaaaccccggtaaagtacggttaacggaccgaaagtacccgtaaacgtacggtggttacggaccttaccganaccgttaacttcgcccttttaagccgttaaccc

SEQ ID NO: 70980 - DNA, 677 bp, Homo sapiens
  misc_feature: GYAE6OF02FKEIO.3.19.B08.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtcctccatccctccctgtctgcatctgtggganacagagtcatcatctcgtcggccggganaagtcagtagttgttagttatttaattaattggtatcagttacaaacgagggaaacaccctaagctcctagacttctagtcgctcgactactacccgtaagttaacgtaaaggttcgggtaccctatacgtaaggttcaggtggtactaggtgtacgtcggtacgggatacgttactttacaccttcacctacgtatacgaagttactactaaccaacgtagtaacgttatttacgacttaaacttacgtactacgtaaccaaacgtaggttaccgttaacctaacccgttaaccccttcccgtacctttaaccgttaaccgggtttcccggggaacggtaaccgggtaacgtaacggggtacggtaactaacgtaacccgtaaaacggtacgttcgggtaaccggtcgttaacgaccctaacgtacctttactacggttcctttaccgtaacccg

SEQ ID NO: 70981 - DNA, 906 bp, Homo sapiens
  misc_feature: GYAE6OF02IBS3J.3.19.B08.1.454.CMB.1.raw
tcagagacgcactccacgaccggtgctcgatttagtgagtcagtaaggggagccagtctcagtcaggacacagcatggacatgagggtccccgctcagctccgtgggctcctgctactctggctccgagatgccagatgtgacacccagatcgacccagtctccactcctccctgtctgctactcgtggtggacgacagtaacgtcaacttcgaacttcttcgttcggcccgggactaaacggtcgaaggtagtttagtttaagtttaatttttaaagttttaaagttcggttaacttaccgttaaggtttaaacccaaaaaccgggtaacggtaaaacccgtaccccccgtttaaagccccgttttaccaggttaaccttacggttaactttcggacccgtttacggacccttaaccgttaccggtttaaaaccgtttaaacggtaaacgggtttccccgggtaccctaacgttaaccggtaaaggtttaccgacgggttacggtacggtaacggtacggttacgttaccgggtaacggtaaacctacgttaacttttcccgaaacgttttcccgtaaccgaaccctttacggttcgtaaacggttaaccgttaacgtaaacccttaaaccgttagtaaacgtttacgttttaccggaactttaaaaccggtttactttaaccggtataacccaaacggttaacgtaccttaacccgacccgttaacccccgtcgttaccgttaaccggtttacccgggttacgggtaccgggtaaaccggttaaactacgggggtacgttaaccgacgttaaaccggtaaacggtcgtttaccggggtacgttaaccaccggtaacctaccgtttaccgttctttacccgggtttacccacgtttaacccccgg

SEQ ID NO: 70982 - DNA, 656 bp, Homo sapiens
  misc_feature: GYAE6OF02GCLT0.3.19.B08.1.454.CMB.1.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (380)..(380): a, c, t, g, unknown or other
  misc_feature (380)..(380): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctggtggagacagagtcatcatctcttcgccgggacaagtcagtagtgttagttatttaatttaaattggtatnagttacaaaccgaaggaacgaccctaagtctcctgatntaattgctggactactacctagtttaacaaaggttcggggtcccatacgtagttcaggtgactaggtggactcgtagggactaagtntttacgacttccgtacacctatctaggttaacgtacttaacctaaaccgtagtaacgttacgtttttacggaccttaacgtttaaaccttacgttaacgtacctaaagtaacgtaacgttaacccgtaacctacccccgttaccggtaccttaccgttaccggttttaccggggacgggtaaccgggaaccggtaagggtacggagtaacgtacgtaaaaccgtacgtacggtcgtacgtaggacctaaccgattcgttcgttcttacgttacccg

SEQ ID NO: 70983 - DNA, 725 bp, Homo sapiens
  misc_feature: GYAE6OF02G8MVE.3.19.B08.1.454.CMB.1.raw
  modified_base (130)..(130): a, c, t, g, unknown or other
  misc_feature (130)..(130): n is a, c, g, or t
  modified_base (191)..(191): a, c, t, g, unknown or other
  misc_feature (191)..(191): n is a, c, g, or t
  modified_base (592)..(592): a, c, t, g, unknown or other
  misc_feature (592)..(592): n is a, c, g, or t
tcagagacgcactccacgaccggtgctcgatttagtgagtcagtaagggggagccagtcgtcagtcaggacacagcatggacatgagggtccccgctcagctccgtgggctcctgctactctggctcganatcgccagatgtagacaccagatgacccagtctcactcctcctgtctcgcatctggtgganacgagacgtcatcactctctcggccggataagtcgaagtacgttagttagttaattttaagtttaaagttggtaacttcgtaacgtttaaccgaaaaaccgagggaaaacctacccccgtaaaagtcccgttaccgtaaggtaaccttacgtaacgtacggtcctacgtacctaacgttacccgttaaaggttaaccgtaaaacggggttccgggttaaccctagttaaccgtaaggttccaggtacgacgtaggtagtacgtgtagggaacagttacttaccacgtttaccacgtaacctagtacgtaagttacgtaactaacgtaaactagtaagtactttacgaacttaacttaacctattacgtaacaacgtagtaaccgttaacaccgttaccccncgttactaccgttacgttacgggacggtaacggtaacgaagggtacgtagtaacgtaacggaaacgttaacggtgtaacccggacgttaccaacgttaaccctagttccgtttacgttaccgttacctacccg

SEQ ID NO: 70984 - DNA, 492 bp, Homo sapiens
  misc_feature: GYAE6OF02FRU65.3.19.B08.1.454.CMB.1.raw
  modified_base (190)..(190): a, c, t, g, unknown or other
  misc_feature (190)..(190): n is a, c, g, or t
  modified_base (264)..(264): a, c, t, g, unknown or other
  misc_feature (264)..(264): n is a, c, g, or t
  modified_base (480)..(480): a, c, t, g, unknown or other
  misc_feature (480)..(480): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttattaaattggtatcagttcaaacaggaanccctaagctcctgatctatgctgcatccagtttacaagtcgggtccatcaagttcagtgcagtggatcgtggacagtatttcactctcactatcagtagtctacaactgaagtatttgactaacttactactgtacaacagacgttacagtacttgtatttctacgtttcgtcctaggaaccaagtgactagtacgaaacgtactgtcgctgcacntctgttctctac

SEQ ID NO: 70985 - DNA, 758 bp, Homo sapiens
  misc_feature: GYAE6OF02G947C.3.19.B08.1.454.CMB.1.raw
  modified_base (160)..(160): a, c, t, g, unknown or other
  misc_feature (160)..(160): n is a, c, g, or t
  modified_base (196)..(196): a, c, t, g, unknown or other
  misc_feature (196)..(196): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcggacccngtcctccactccctccctgtctgcatctggtggganacagagtcatcatctcgttacggccgggactaagtcaagtagttagtttaattaattttaatttaaagttggtaattacgtaacgttaaccgaaaaccggaagggtaaacctaccccgttaacgccttaccgtagtactcttatcgactgtactacttacgtaagtttaacgaacgggttccggtacctaagtacggtaaaggttccgtaggtacggtcgtaagggttcggtaacgttcgggtagggtaactaacggttacctttaccacgttacctaccgtaactaccgttaacgtaagttaacgtaacctaaacgtaaccttaggttaacgttactttacgaaccttaaacgtttaactacgttacgtaacgaacgtaagttaaccggtttaaccgacccttaaccccgtcgtaccctttacggtaccggtttaccggggaacgggtaacggaaccggttaaggtcgggtaacgtaataacccgggtaaacgtacggttacgggtccgtaaccgtcggaacccttaacgttcttaccgtcgtttaccttacccgttcccg

SEQ ID NO: 70986 - DNA, 666 bp, Homo sapiens
  misc_feature: GYAE6OF02ICP6Y.3.19.B08.1.454.CMB.1.raw
  modified_base (197)..(197): a, c, t, g, unknown or other
  misc_feature (197)..(197): n is a, c, g, or t
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (642)..(642): a, c, t, g, unknown or other
  misc_feature (642)..(642): n is a, c, g, or t
tcagagacgcactccacgaccggtgctcgatttagtgagtcagtaagggggagccagtctcagtcaggacacagcatggacatgagggtccccgctcagctcctgggctcctgctactctggctccgagatgccagatgtgaccacccagatgacccagtcctccatccctccctgtctgcatcgtgtggagacagntcatcatctcttgccgganagtcagtgtgttagtatttaatttaattggtatctagttacaaaccgagggaaacncccctaagtcctcctgtattactagtcgtctgctataccttaagtttacgaaacggttcgggtaccctagtacgttaagggttactacggtaggacgtaggtacgagttacggtagggtactaagttactttaccgtaccttacgtacctacctagtctaacgttacgtacctaacgttaacctagtaacgttacgttttacgactttaaactttaccttaacgtcgtaaacctaacgtacgtaacggtttaacctacccgttaccccgtaccgtaccttaccgtcggtttaccgggaccgggtaacggtaaccgtagggtacgaggtacctaacgaaacggtacttggaccggttacgcgacctacgtnttaccgtcttacctcttaacccgg

SEQ ID NO: 70987 - DNA, 833 bp, Homo sapiens
  misc_feature: GYAE6OF02HWFPV.3.19.B08.1.454.CMB.1.raw
  modified_base (204)..(204): a, c, t, g, unknown or other
  misc_feature (204)..(204): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatgccagatgtgacacccagatacgaccctagtcctcctattccctccctggtctgcctatcgtaggtggganacgagagtcatcatcttcgtcggccggacaaggttcagtagttgtttaagttaatttttaagtttaaagttggtatacgtaacgttaaccaaaacgtagggtaaaacctcccgtaaaggtcctacgtagacttctagcgtctcgactacttaccgtaagttaaccggtaaggtccgggtaccaagttacgtaaggttacgacggttacggtactaggtagtaacgttcggttacggggaactacggtttaccgttttaccgaaccgttcctaccgtaacctaagtacccgtacgtttaacgtaacccttaaccgaaaccgttagggttaaactttacgtttacgaaacttaaaccgtttaccttaagtccgttaaactaaacggtacgtaaaccgttaacccgtaacccttaaccccggccgtttaaccttaccgtaccgggtttaccgggacccggggtaaacggtaaccgtaaagggggttcctaaaaggtaacgttaaaccccgggtaaaacggtttaaccggtcggggttaacccggtttacccggaaccgtttacccggaaaacccgttcggttttaacccccggtttaacgttttaccccggttaaccgtttaaccccccggg

SEQ ID NO: 70988 - DNA, 615 bp, Homo sapiens
  misc_feature: GYAE6OF02FOYEF.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagccatcatctcttgccgggcaagtcagagtgttagtatttattaaattggtatcagttacaaacaggaaacgcccctaagctcctagatctatgctgctatccagttacaaagtcgggtacctatacaaggttcagtcggcagtggatcgtggaactagtactttacacttctacaccatcagttacgtctaactaaccgtgtaaacttatttcgaccttaaactttactacgttacgtacaaacgtagtaaccgttaaccgaccttacccccgtccgtaccttaccgttacctttccggggacggtaacgggtaccgaagggttcgggacgtacgtaaccgtaaaacggtaccgttacgggtacggtaaccgttagacccgttaacctaccgtttacctcggttaccttcttaaccccg

SEQ ID NO: 70989 - DNA, 581 bp, Homo sapiens
  misc_feature: GYAE6OF02IVGS4.3.19.B08.1.454.CMB.1.raw
  modified_base (370)..(370): a, c, t, g, unknown or other
  misc_feature (370)..(370): n is a, c, g, or t
  modified_base (444)..(444): a, c, t, g, unknown or other
  misc_feature (444)..(444): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcgttcggccggcaagtcaggtagtgttagttaatttaatttaaagttggtatctaagttacaaaccgagggaaactcccctaagcctaccgtgattctatgctgctatctaagtttaacgaagtcgggtaccagtcaaggttcagtggcaggtgatcgtggaacngtattcacttcctacacctatcgtaacgtcgtctaactaactagtaagtactttacgacttaacttacttactntactaacgtactacgttaaccaccttacccctccgtaccttaccgtccgttccgggacggtaacgggtaaccgtacggtgaggtactaaccggtaaacgtacgtaggtcgactgacctctatcgtcgtttctactcc

SEQ ID NO: 70990 - DNA, 728 bp, Homo sapiens
  misc_feature: GYAE6OF02FW5A6.3.19.B08.1.454.CMB.1.raw
  modified_base (201)..(201): a, c, t, g, unknown or other
  misc_feature (201)..(201): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgacccagtcctccatccctcctgtctgcatctggtgggagacagagtnatcatcttcgtcggccggactaacgtcgagtagttagttaagttatttaatttaagtgtatcgtacgttaacaaacgaggaaccacctagcctcgtagtatacgtagtcgtctcgactacgttaccgtaagttaacgaacgggttcggtacctagtacgtacgttcgagtcgacgaggtagtacgtggtacgaactagtacttacacctactaccactacgttacgtagtacgtacctaaaccgttacgtaaagttaacgtttacgttacgtaaacccttaacttttacgacgtttacgaaacgtaacgtacgttaaccggttaacccgtaccccttaccccgttacgtacctttaacccgggttaccggttaacggggaaccggtaaacggtaacggtaacgggtacggtaacgttaaccgtaaaccgggtaaaccgttacgggtccgggttaaccgtacgtaacccggtaccctaacccggtttacgttacccgttacggtttaacccttcccggtttaaccccg

SEQ ID NO: 70991 - DNA, 769 bp, Homo sapiens
  misc_feature: GYAE6OF02IV699.3.19.B08.1.454.CMB.1.raw
  modified_base (180)..(180): a, c, t, g, unknown or other
  misc_feature (180)..(180): n is a, c, g, or t
tcagagacgcactccacgaccggtgctcgatttagtgagtcagtaagggggagccagtctcagtcaggacacagcatggacatgagggtccccgctcagctccgtgggctcctgctactctggctccgagatgccagtatgtcgacacccagatcgacccagtcctaccactccctcctntctgctatcgtggtgggacgtacgagtacgtactactacgtacttccgttcgttcgggacccggtacgtaacgttacgaggtacgtttaagtttacggtttaattttaaagttttaaaggttacggttacttaccggtaaacgttaaccgaaaaccgggtaagggtaaaccccgtacccttaaggtccctttaccggtaagtacgttagtacgtagtacctacggtacctaacctttaccggtaaagtttaacggtaaccgggttggtacccctaagttaacgtacggtacgttagacgtagtacggtagtacggtactacgggacttaagtaccttcgacgttacctaacgcgtaactcggtaacgtaactacgtaaccgtacttacggttaacttcgtttacaacgttaccgttaaccgtacgttacgtaaccgtaactaacgtacgttacctaaccttacccgtacctcgtaccgttaccggtacgggtacggtaccggtaaccgtagtaccgactacggtaaccgtacggtacgttacgacgttaccgtacgaccgttacgtccttagtcttacgtcttaacccg

SEQ ID NO: 70992 - DNA, 624 bp, Homo sapiens
  misc_feature: GYAE6OF02FZKNV.3.19.B08.1.454.CMB.1.raw
  modified_base (196)..(196): a, c, t, g, unknown or other
  misc_feature (196)..(196): n is a, c, g, or t
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
  modified_base (552)..(552): a, c, t, g, unknown or other
  misc_feature (552)..(552): n is a, c, g, or t
tcagagacgcactccacgaccggtgctcgatttagtgagtcagtaagggggagccagtctcagtcaggacacagcatggacatgagggtcccccgctcagctccgtggggctcctgctactctggctccgagatgccagatgtgacacccagatcgacccagtctccatccctccctgtctgctatctggtggganacagagtcatcatctctcggccggacagtcgagtagttgttagttatttattaagttgtatntagtacaacgaggaacncccgtaagctactgtactctagtcgctagctatacctaagttaacgacggtcggtaccagtacgtaacgtctaggtcgacgtagtcggatcgtaggactaagttcttacgacctctacacctatacgtacttgtacctaactaacttagaactttagtttacgaaccttaacttaaccgtacgttactaaccaaacgttcgttaaccgtttaaccgcccttaccccgttcgaccgtttaccgttaccggttccgggacggtacggtacgaagggttnaacgtagtaacccgtaagtacgttcggacggtaccgtctaaccgtctacgttccttacgtcctcgttaaccc

SEQ ID NO: 70993 - DNA, 871 bp, Homo sapiens
  misc_feature: GYAE6OF02HO884.3.19.B08.1.454.CMB.1.raw
  modified_base (94)..(94): a, c, t, g, unknown or other
  misc_feature (94)..(94): n is a, c, g, or t
  modified_base (346)..(346): a, c, t, g, unknown or other
  misc_feature (346)..(346): n is a, c, g, or t
  modified_base (759)..(759): a, c, t, g, unknown or other
  misc_feature (759)..(759): n is a, c, g, or t
tcagagacgcactccacgaccggtgctcgatttagtgagtcagtaagggggagccagtctcagtcaggacacagcatggacatgagggtcccgntcagctcctggggctcctgctactctggctccgagatgccagatgtgacaccgagagtcgacccagtctaccacttccctccctgtctggactactcgtggtacgggaactaccgagtaacgttccaagttcctaacttccttacgttcggacccgggtataagttcgaggtacgtttggtttaacgttaacgttttaaatttaaagttcggttaactcgtaacgttaccgaaaaccggacggggtaaaccnccccgttaaaggtcccttaccgtagtaacttcgttacttcggaccttacgccgttaccttaaccgttaaaacggttttaaaccggaaaacgggtttccggggtacccctaagtttaacccgggttaaaggttacgtcgggtcggtaaccttagggttacggtacgttacggttagggaacttaacggttccttttaccgaccggtttctacccgtaactacgttacgtacgggtttaactaccggtaaccgtaaaccgtggttaaactttagttacgtaccgtaacttttaactacggtacgtaaccgtaaacgttcgtaaccgtttaaccgtaacccgtttacccgtaccgttcccttaccggtacggtttacccggggaaaccggttaaacgggtaccgtaaacgggggtntaaccgggttaacgttaacccggaaaaccggtaccggttggtaaccggtaccgtaacggtaccccgttaaacggttctttaaccggttacggtttcctaacccggtttaccc

SEQ ID NO: 70994 - DNA, 755 bp, Homo sapiens
  misc_feature: GYAE6OF02GC86B.3.19.B08.1.454.CMB.1.raw
  modified_base (95)..(95): a, c, t, g, unknown or other
  misc_feature (95)..(95): n is a, c, g, or t
tcagagacgcactccacgaccggtgctcgatttagtgagtcagtaagggggagccagtctcagtcaggacacagcatggacatgagggtccccgntcagctcctggggctcctgctactctggctccgagatgccagatgtgacacccagatcgacccagtcctccacgtccctccctgtctgcctagtcgtggtgggacacagtagtcatcacttctcgttcggccgggtactaagtcaggtagttacgttaagtttaattttaagtttaaagttggttaatacgtaacgttaaccgaaaaccggtaagggtaaaccctaccccgtaacggtccgttaccgtaagtacttacgtagtcgtctacggctaaccgttccgttaaagtttacggaacggttccgggttaccctaagttaccggttaacgttccggtaggtacgggtacgtaagggtcgtacgttcggtaacggggacttaacggttacttaccgtaaccgttcctacgaacctacgtacgtaacgtaccgtaaccgttaaccgaacgttaacgtaagtttactttaccgtaaaccttaacgtttactacgtcgtaacacgtaacgttacgtacccgtacctacccctcgttaccgtacgttaccggttaccgggacggtaaccggaacgtacgggtacgtacgtaacgtaacggtaaacgtcggttagtaccggcttaacgcctacgttctacgttccgttaccttccgttaacccg

SEQ ID NO: 70995 - DNA, 638 bp, Homo sapiens
  misc_feature: GYAE6OF02IRB1U.3.19.B08.1.454.CMB.1.raw
  modified_base (95)..(95): a, c, t, g, unknown or other
  misc_feature (95)..(95): n is a, c, g, or t
  modified_base (192)..(192): a, c, t, g, unknown or other
  misc_feature (192)..(192): n is a, c, g, or t
  modified_base (219)..(219): a, c, t, g, unknown or other
  misc_feature (219)..(219): n is a, c, g, or t
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
tcagagacgcactccacgaccggtgctcgatttagtgagtcagtaagggggagccagtctcagtcaggacacagcatggacatgagggtccccgntcagctcctggggctcctgctactctggctccgagatgccagatgtgacacccagatcgacccagtctccatcctccctgtctgcatctggtggganacagagtcatcatctcttggcccgganagtcagtagttgttattaattttattaaagttgtatctagttacaaacgagggaactaccctaagcctacctagacttcgtatcgntagactactctaagttacgaaggttcgggtccatacgtaggttcaggtcgntacggtagacttcggtaggaatgttactttaccactcctaacaccgtactacgtaacgtaactacctaaacgtaaccgttagtaagttactttaccgaaccttaacttacttactacgtaactaacgtacgttaacttaccgtacctccccgtaacctccttaccgtaaccgttccggggaacgggtaacggtaacgtaaggtccgaagtaccgtaaacgaacggtaacgtcggtacgtcgtacgtaacctacgttactacgttcgttaccttacgtacccg

SEQ ID NO: 70996 - DNA, 782 bp, Homo sapiens
  misc_feature: GYAE6OF02FQWQE.3.19.B08.1.454.CMB.1.raw
  modified_base (195)..(195): a, c, t, g, unknown or other
  misc_feature (195)..(195): n is a, c, g, or t
tcagagacgcactccacgaccggtgctcgatttagtgagtcagtaaggggagccagtctcagtcaggacacagcatggacatgagggtccccgcgtcagctcctggggctcctgctactctggctccgagatgccagatgtgacacccagatgacccagtctccatcctccctagtctgcatctggtgggacganagagtcgatccattcttacgttgtcccggggataaggtcctaaggacgtttaggttaagtttaattttaacgtttaaaagtttggttaattcgtaaggtttaccgtaaaaccgtaacggggtaaaccgtaccccctaagtaccttaccgttaggtacttacgttaagtcgtcctacgcctaacgttcccttaagtttaacgtaaggttccgggttacccagttacgtacggttacaggtacggtaccgtaggtacggtagttccgtagggtaactagttacttaccgtacgttacctaccgaaccttacgtaaccgttaggtaacgttacccggtaactaaaccgttacggttaaacggttacgttttaaccgacttaaacggttaccttaacggtttacgtaacctaacgttaggtaaccggttaaacgtacccgttaacccgtaccgtaccgttccttacgtttacccgggaacggttacgtaaccggtagggttacgacggttactaaccggtaacggttaacgttcggaggtaccgttaccggaacctaccgtagttcccgtacgttaccgtaccgttacccg

SEQ ID NO: 70997 - DNA, 807 bp, Homo sapiens
  misc_feature: GYAE6OF02JHQ8O.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtcctccactccctccctgtctgcatctggtgggagacgagagtcatcatctcgtcgccggacaagtcagtgttgttaagttaattttatttaaagttggtacttacgtaagttaccaaaaccgtaagggaaaccaccccgtaaacggcccttacctagtacttacctagtacgcgtacgactacttaccgtaacggtttaaacgaagggttccgggtaccaagttacgtaaggttcgagtacggctaggtgtatacggtaggaactaggtactttaccacgttcctaaccgtacctacttacggttaacgtacgttaaaccctaacgtaaaccgttggtaaagtttacgtttaaccgacctttaaaccgtttacgtaacccgttacgtaaccgtaaacgttacggtaaaccgtttaacccggaacccttacccccggttccgttaccgtttacccgttaacccgggttttccggggaacccggggtaaaccgggttaaccgggttaaacggggtaccgggttaacccggtaaacttaaaccccgggtaaacgggtacccggttaaggttcccgggtaacccttccgggtaaaccccttacggttaccgttacccgggttacctttacggtttacccccgttaaccg

SEQ ID NO: 70998 - DNA, 732 bp, Homo sapiens
  misc_feature: GYAE6OF02FPH22.3.19.B08.1.454.CMB.1.raw
  modified_base (192)..(192): a, c, t, g, unknown or other
  misc_feature (192)..(192): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatgacccagtctccatcctccctgtctgctatctggtgganacagtagtcatcactctacgttcggccgggataagtcgagtagttagttaatttaatttaagtttaaagttggtaacttcgtaagttaaccaaaccgtaagggtaaacctccccgttaagtccttaccgtagtacttacctagtcgtccttacggccttaacgttaccctaaaggttttaaccgaaaggggttccgggtaccctaagttaacggttaacggttacgaaggttcggacgtacggtaggtacgttcggaacggtacttagttaccttttcgacctttaccaccgtaccgtattacgaacggtttactaaccgtaacgtaacgttaagtaactttacgtttaccgaacttaactttacctacgttactaacctaagtacgttaaccgtaccgtaaccctacccgttaccgccgtttaccgttcccggttacgggtaacggacggtaaccgtaaggcggtactacgtaaccgtaaacgtggttacggtacgtactacggactaccggttatacgttccggttacctcgttaccc

SEQ ID NO: 70999 - DNA, 797 bp, Homo sapiens
  misc_feature: GYAE6OF02FG1BX.3.19.B08.1.454.CMB.1.raw
  modified_base (201)..(201): a, c, t, g, unknown or other
  misc_feature (201)..(201): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgaaccctagtcctccatccctccctgtactgctatcgtggtaggganacgagtagtcctatcattccttcgtacggccgggataagtcaggtagttgttaagttatttaagttaaattggtaattcgtaagttaccaaacgtagggaaacctccccgtaagtccctccgtagacttactactcgctacgactacttactaacgttttaacgaacgggttccgggtacccctaagtacgtaaacggtttcgagggttcggacgtaggtcggtacgtacggtaggtaaaccgtagtttaccgttttcgaaccctttcaccgtaaccgttaactacgtaacggttaaccttaaccgtaaaccgtaaccgttaagggtaaactttacttaaccggaactttaaaccttaccgttaacgttacgtaacccttaaacgacgggtttaaccttaaacccgccctttaaccccggtccgttacctaaccggttttaaccgggttacccgggacggtaaaccgggttaaccgtaagggtaacccgggaattaccggaaaacgttaacccggggtattccggggtaacgttcccggtaacgtacccgttacgaaccgtttcccgttacggtttaccctcgttaaccccggggg

SEQ ID NO: 71000 - DNA, 854 bp, Homo sapiens
  misc_feature: GYAE6OF02GBZFX.3.19.B08.1.454.CMB.1.raw
  modified_base (160)..(160): a, c, t, g, unknown or other
  misc_feature (160)..(160): n is a, c, g, or t
  modified_base (192)..(192): a, c, t, g, unknown or other
  misc_feature (192)..(192): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtcgacacccagatcgacccngtctccatcctccctgtctgcatctggtgganacgagacgtcatcattccgtcgttacggccggtactaaggtcaagtacggtttgtttaagtttatttttaaatttaaagttcggtactcgtagttaccgaaaaccggtaggggaaaccctaccccttaaggcccttaccgtagtacgttctagtcggtctacggacctaacgtacccttaaggtttaaccgtaaacgggttccggggtacccctaacgttaccggtaaacggttccgaagggttcgggtaccgtaacgggttacggtaaacgttcgggtaaacggggtaacctaaggtttaccgttttaaacccacgtttaccctaacccgtaacccgttacgttaaacgtaccggtttaaacgttacccttaaaaccgtaacgttaagggtaactttaacgtttaccgaaacccgttttaaacctttaacggttaccgttacgtaaccgtaaacgttacggttaaaccgttaccgtaaaccccgttaccccgtccgttaccttaccggtttaacgggttaccgggaaccgggtaacggtaaccggttacgggtaacgggtaccgttaacgaaaccggttaaaccggttaccgttagggtaccggtacgtacccgtaccgttaccgtacgtttccggtactttacccggttcttaaccccgg

SEQ ID NO: 71001 - DNA, 722 bp, Homo sapiens
  misc_feature: GYAE6OF02HBIYP.3.19.B08.1.454.CMB.1.raw
  modified_base (158)..(158): a, c, t, g, unknown or other
  misc_feature (158)..(158): n is a, c, g, or t
  modified_base (191)..(191): a, c, t, g, unknown or other
  misc_feature (191)..(191): n is a, c, g, or t
  modified_base (531)..(531): a, c, t, g, unknown or other
  misc_feature (531)..(531): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccngtctccatccctccctgtctgcatcgtgtgganacagagtcatcatctacgtcggccggacaagtcaagtagtgttaattaattttagtttaaagttggtacttacgtattaaccgaaaccgtaagggaaaccgtccccgtaaagcccttacccgtagtacgttacctagtacgccgttagaccttacgtacccttaaaggttttaaccgaaaacgggttccggggtaacccctaagttacgtaaaggtttcgtaacgggttggacgttaaggtagggtacgtttacggtaggggtaactacggttactttaccaaccttctaccgaacctagtacgtagttacgtaccgtaacctaacgttagtaaacgttntttaacgaccttaaactttactaacgttacgtaactaacgtagttaacgtacgtaccctacccctcgtacctaccgttaccgttacgggacccggtaaacggaccgtaagggtcgagtactaacggaaacttacggacggttacgaccgtagaccgtaccttacgtacgtttccttagtaccccttaaccg

SEQ ID NO: 71002 - DNA, 983 bp, Homo sapiens
  misc_feature: GYAE6OF02HATLC.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatgacccagtcctccatcctccctgtctgcatctgtgggagacagagtcactcatccttcttcggccgggactaagtcgaaggtagttaggtttagttaatttttaaagttttaaaagtttgggttaacttacgtaacgttttaaccaaaaacccggtaaacgggggtaaaccgtacccccgttaaagacccgttaccgtacggtaacttacctttaagttccggccgttacggtaccttaacttccccgttaaacgggttttaaacgaaaacggggtttccgggggtaaccccctttaagtaaccggttaaacggtttaccggacgggtttacggggtaccgtaaggggttacggtacgtttaccgggttaaggggtaaacctacgggtttaaacttttaccccgtaacgttttacccgttaaccctaacccgttaaccgttaaccggttaaacggtttaaccgggtttaaaccccttaaaaccccgttaaacccgtttaaaggttaaaccgtttacgttttaacgtaaaccctttaaaccgttttaaccgttaacggtttaaccttaaacctaaaccgttaaccggttaaacggtttaacccggtaaaccctttacccccgttaaccggttaccccgtttacccggtttaacccgggtttaccgggtaaccggggtaaacccgggtaaaccggggttaacgggtaacgggggttaacgttaacgtaaccgggtaaaaacccggtacccggttacggttacgggtaccgttaacggtacctaaccggttaccttaaccgggtttaccctttaccggtttaacccttacccgg

SEQ ID NO: 71003 - DNA, 633 bp, Homo sapiens
  misc_feature: GYAE6OF02FMQZO.3.19.B08.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
  modified_base (267)..(267): a, c, t, g, unknown or other
  misc_feature (267)..(267): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (621)..(621): a, c, t, g, unknown or other
  misc_feature (621)..(621): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatgacccagtctccactcctccctgtctgcatctgtggganacagagtcatcatctctggccggnagtcagagttgttatattttattaaattggtatcagttacaacgaggaacnccctagctcgtnatntatcgctgcattcctaagtttaacaacggtcgggtacccagtacgtaacggttcgaggtcgtacgaggtgacgttcggtacggtactagttactttacctaccttactcctacctagtccgtaagttaccgtaactaaccgtaaacctaggtaaacgtttgtttaccgaacctttaacctttaactacttcgtaactaacgagttaaccgttactacctaccccgtcgtacctaccgttcggttaccgggaccgggaacggtaccggtaagggtcgaagtaccgtaagaaacggtacgttgggtccgtacgtctacggacccttagttcgttacccgtnttacccgtcccg

SEQ ID NO: 71004 - DNA, 735 bp, Homo sapiens
  misc_feature: GYAE6OF02F0GCW.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtcctccactccctcccctgtctgcattcgtggtgggaagacgagatcatcactcttcgtcggccgggacaagtcgaggtagtagtttagtttaattttaatttaaagttggttacttacgtaagttaaccgaaaaccggaagggtaaacccgtaccctaaacggccttacccgttagacttaccgtacgtcgccttagcctaacttacccgttaacggtttaacggtaaacgggttccgggtacctaagtaacccggttaaggtacgtaggtcggtacgtagttcgggtactcggtacgggaacttagttactttaccgtaccgttctaccaccggtatacgtaacgttacttaactaccgtaacgttagttaacggttctttaacactttaacttaacctagttaccgaataaccgtaagttaccgttaaccctacccgttacccgttaccctcgttaccttaccgggttccgggtacgggaaacgggtaccgagggtacgacgtaaacaaccggtaacgtacgtcgggtacgtacgaccgcttaacgtcgtacgttcttccgtaacttcccg

SEQ ID NO: 71005 - DNA, 626 bp, Homo sapiens
  misc_feature: GYAE6OF02HH2XB.3.19.B08.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (456)..(456): a, c, t, g, unknown or other
  misc_feature (456)..(456): n is a, c, g, or t
  modified_base (559)..(559): a, c, t, g, unknown or other
  misc_feature (559)..(559): n is a, c, g, or t
  modified_base (603)..(603): a, c, t, g, unknown or other
  misc_feature (603)..(603): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtctccatccctccctgtctgcatctggtggganacagagtcatcatctcgtgccggnaagtcagngttgttagttatttaattaattgtatctagtacaaacgaggaacnccctaagcctctgattctatgctnactactacctaagttaacgaaaggttcgggtaccctagttaccgtaaggtttccaaggttcggactaggtaggtactcggtagggactagtactttaccaccttcgtacctaccagttaccgtagttaaccgtacctaacgtaaaccgttagtaaacgttntttacgaactaactttaaccgttactacgtaacaactagaacgttaaccacttacccccgtactcttaccgtacgttcgggaacggaacggaaccgtaacggngaacgtactaacggaaacgtacgtgtacggactacgactaaccngttcccgttatacctcgttaccc

SEQ ID NO: 71006 - DNA, 739 bp, Homo sapiens
  misc_feature: GYAE6OF02HM1QR.3.19.B08.1.454.CMB.1.raw
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (274)..(274): a, c, t, g, unknown or other
  misc_feature (274)..(274): n is a, c, g, or t
  modified_base (420)..(420): a, c, t, g, unknown or other
  misc_feature (420)..(420): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgaccctagtctccatcctcctgtctgcatctgtgggagacagatnatcactctcgtgccgggnaagtcagtagtnttagttaattttaattaagttgtatctaagtacaaacgagggaacnccctaagtcctacctaggacttactatcgactgtaccaacttctaaagttaacgaaaggttccggtacctaatcgaacgttcaaggtcgacgaaggttcgagtcggtagtacgtaagtactttacgacttccgtaacaacccgtanaccgtaagtttaccgaacgttaaccgtaaccgttaggaaacgtttcgttaaccggtacctaaaccgttacgtaacctacggtaaaccgtaacgttagtaaccgttaacccgtacttaacccccgttcgtaaaccggttcccttaacgggttaaaccggggtaccgggtaaacggttaacccggaaagggttaacccgtaacggttaacccgttaaaacggtttaacgaaccgggttttaccggaacgggttaacacccgttaaaaccggttctaaacccttttgggtttaaccctttacggttaaccctttaaccccgg

SEQ ID NO: 71007 - DNA, 748 bp, Homo sapiens
  misc_feature: GYAE6OF02HTRLE.3.19.B08.1.454.CMB.1.raw
tcagagacgcactccacgaccggtgctcgatttagtgagtcagtaagggggagccagtctcagtcaggacacagccatggacatgacgggtccccgctcagctcctggggctcctgctactctggctccgagatcgccaggatgtgaccacccaagtactcgaccctagtcctccatccctccctgtctcgctatcgtggtggacgtacagacgtcaatcgaattctacgttcggaccgggactaaagtcgtaagtacggttagttaagtttattttaaactttaaagttcggtatactaacgttacgaaaaccgtaaggggtaaacctaccccgtaataccgtacctaggtaactacgtatcgtactagtcgtaactacgttaagttaaactaagggtccggtacctaagtaccgtaaaggttctacggtaggaccgtaggtagtactcggtagggtacctaggttacttacgaccgtactaccgtacactacgtaacgtttacgtactaaccgtactacgtaaattcgttttacgaaaccgttaaccgttacgttaacgtacgtaacgaaacgtacgtaacggttaacctaacccgtacccgttaccgtccttaccgtaaccggtttcgggaaccggtaaccggtaacgtacgggttacggaacgtaacgttaaccggtaaaacggtaccgtggttaacgcgtaaccgaccgtacgtacgttcctacgtttaccgaccgttacccg

SEQ ID NO: 71008 - DNA, 702 bp, Homo sapiens
  misc_feature: GYAE6OF02FNI2S.3.19.B08.1.454.CMB.1.raw
  modified_base (164)..(164): a, c, t, g, unknown or other
  misc_feature (164)..(164): n is a, c, g, or t
  modified_base (168)..(168): a, c, t, g, unknown or other
  misc_feature (168)..(168): n is a, c, g, or t
  modified_base (201)..(201): a, c, t, g, unknown or other
  misc_feature (201)..(201): n is a, c, g, or t
tcagagacgcactccacgaccggtgctcgatttagtgagtcagtaagggggagccagtctcagtcaggacacagcatggacatgagggtccccgctcgagctccgtggggctcctgtctactcgtggctaccgagatcgccagatgtgaccaccagagtcaccngtcnccactccctcccgtgtctgctatcgtggtgganacgagagtcatcatcttcgtcggccggatagtcgagtagtagttagttaatttaattaagtggtacttcgtacttaaccaaacgacggaaccgacccgttagccgtaccagtactcgtacgtcgcgtacgctacgtaccgttagttaacggaacggttccgtaacctgtacgtaggttcgaggtcgagtgtacgcgtcgtaggactaacgtcttaccacgttccacgtactacgttaccgtacgttaacgtaccttaaaccgtacgtaggttacgttacgttacgtaaccgttaaccttacgtacctacgttaaccgaacgttacgtaccgttaaccctacccgttaacccgtccgtaccgttacgttacccggtacgggtacccgggtaacggtaacgggtacggtacggtaccgtaacgtaaccgtaacgggttaccggacggttaaccggacgttaccggacctttacctacggttcgttacgttaccttccgtaccg

SEQ ID NO: 71009 - DNA, 597 bp, Homo sapiens
  misc_feature: GYAE6OF02GI5SP.3.19.B08.1.454.CMB.1.raw
  modified_base (95)..(95): a, c, t, g, unknown or other
  misc_feature (95)..(95): n is a, c, g, or t
  modified_base (190)..(190): a, c, t, g, unknown or other
  misc_feature (190)..(190): n is a, c, g, or t
  modified_base (412)..(412): a, c, t, g, unknown or other
  misc_feature (412)..(412): n is a, c, g, or t
  modified_base (446)..(446): a, c, t, g, unknown or other
  misc_feature (446)..(446): n is a, c, g, or t
tcagagacgcactccacgaccggtgctcgatttagtgagtcagtaagggggagccagtctcagtcaggacacagcatggacatgagggtccccgntcagctcctgggctcctgctactctggctccgagatgaccagatgtgacacccagatgacccagtctccatcctcctgtctgctatctgtggganacaggacgtcatcgatctcgtcgccggataagtacaaagttatagtaactcgtgcctgtactcagtacaaacgtaccaggactacgaacgtacccaaagccttaccttaatcctcgtagtactcgtacctactatttcgacctacgtacggtccgggtacccaacgtaaccgttcgaacgcggcaaggtcgagtcgtaggactagtactcactcacaacgtntacgatacaggtcctgaccgcgctagaacgtacnggtccgtactaagttactacgtacaccaacgtagtaacgttgtactttaagttacgttacgggtacgttaccgggtaacccgaggtaaccaaaggtactaaccggaaattaacgaaccgtaacggttctacggacttacgtacctattacg

SEQ ID NO: 71010 - DNA, 642 bp, Homo sapiens
  misc_feature: GYAE6OF02HYMCU.3.19.B08.1.454.CMB.1.raw
  modified_base (191)..(191): a, c, t, g, unknown or other
  misc_feature (191)..(191): n is a, c, g, or t
  modified_base (330)..(330): a, c, t, g, unknown or other
  misc_feature (330)..(330): n is a, c, g, or t
tcagagacgcactccacgaccggtgctcgatttagtgagtcagtaagggggagccagtctcagtcaggacacagcatggacatgagggtccccgctcagctcctgggctcctgctactctggctccgagatgccagatgtgacacccagatgacccagtctaccatcctcctgtctgacatcgtggtgganacagagtcatcatcttctgccggacaagtcagagtgttatatttaatttaattgtatctagtacaaacgagggaacgtccctaagtctacctgactcttatgactcgcacgttctagtttaacaaggttccgggtaccncgttaagacggttacgacggttaggacctaagggttcgaacgttcggtagggtaacgagtaacgttttcacgttcctaactacctatccgtaagttactacgtaacctaactacgttaaatgttttaacgacttaaccttaacgtacgttaagtaccgtaaaacggttaacggtaaccgtaaccgtaccccttccgtacgtccgtaaccgtttcggccgggtaaagaaccgggtaggtagggacgtagaaccgtaaacggtagtacggtcgcgttaacgcgtaactgtaacgttccgttacttacgtacccg

SEQ ID NO: 71011 - DNA, 724 bp, Homo sapiens
  misc_feature: GYAE6OF02GOQUE.3.19.B08.1.454.CMB.1.raw
  modified_base (193)..(193): a, c, t, g, unknown or other
  misc_feature (193)..(193): n is a, c, g, or t
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
  modified_base (682)..(682): a, c, t, g, unknown or other
  misc_feature (682)..(682): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatgccagatgtgaccacccagatcgacccagtcctccatccctcctgtctgcatctgtggganacagatcatcatctctcggcgggcaagtcagngttagttagttatttaatttaatgtatactagttacgaaacgtaagggaactccctaagtcctacctanacttctatcgtactcactaacttcctaagttaacgtaacgggtcgggttacccagtaccgtaagttcgaggtcggtacgtaggtacggtagtccgtagggtactaaggttactttacctaccgttcctaccacgtacgtacgtaacgttaccgttaacctaacgtaaacgttacgtaaagttaccgtttacgtaaccttaaacgtttacctaaccggttacttaaccgtaaacgtaacggttaaccgttaaccgtaacccgttaacccccgtacgtttaacccggggtttacccgtaaccgggttaaccggggtaaaccccaaaggttaccggtaagtaaccgtacttaaccgaaacgtaacggtacgggtcggtaactccggtaacnccgtttactcgttcccgtttacttaccgttaccgttaccccg

SEQ ID NO: 71012 - DNA, 739 bp, Homo sapiens
  misc_feature: GYAE6OF02FZPBU.3.19.B08.1.454.CMB.1.raw
tcagagacgcactccacgaccggtgctcgatttagtgagtcagtaagggggagccagtctcagtcaggacacagcatggacatgagggtccccgctcagctcctggggctcctgctactctggctccgagatgccagatgtgacacccagatcgaccagtctccatccctccctagtctgctatctggtgggacacagagtcatactatctcgttacggcccgggataagtcgagtaggttagtttagttaatttttattaaagttggttacttactaagttaaccaaaaccgtaaggggaacctacccccttaagacccttaccgtagtacttcgtagtcgtccgtagtactaacctaccgttaagtttaaacgtaaaccggggttccgggtacctaacttacggtaaacggtttacgagggttcggaccgttggtaggtattccgggaggtaacctagtttacggtttaccacgttaccgctaaccacttacgtacgtttaccgttaactaaaccgtaacgttagtaaacgtttactttaacaccgttaaacctttactacgttacgtactaaacgtacgttacgtaacccgttaacccttacccgttacgtaccgttaccgttaccggtttaccggggaagggtacccgaagggtagtacggagtagtaaacccggaagttaccgtggttacgaccttacggaccttaccgtagttctacggtttacctcggtacc

SEQ ID NO: 71013 - DNA, 829 bp, Homo sapiens
  misc_feature: GYAE6OF02I7LYL.3.19.B08.1.454.CMB.1.raw
  modified_base (790)..(790): a, c, t, g, unknown or other
  misc_feature (790)..(790): n is a, c, g, or t
  modified_base (796)..(796): a, c, t, g, unknown or other
  misc_feature (796)..(796): n is a, c, g, or t
tcagagacgcactccacgaccggtgctcgatttagtgagtcagtaagggggagccagtctcagtcaggacacagcatggacatggacgggtccccgctcagcctccgtgggctcctgctactctggctccgagatcgccagagtggtcgaaccgacccagactcgaacccgtgtcctaccactcccttcctcgttcagctacttcgtggtggagtacgaggtatctatcctgttccgttcgtcgggtaccggactaacggtcaaggtaggtttacgtttagtttaacttttaaggttttaaagttcggttaattacgtaacgttaaccggaaaaccgtaaacgggtaaacccgtaacccgtaacgtcccgtaccgtagtaccgttacgttacgtcgtcgtacgtccgtaacttaccgttaaacgttaacggtaacggtaccgggttaacctaccgttaacggtaacggttacggtagggtaccgaaggttacggttagggtaacgttacggtaacggggtactaaccgtttacgttaaccgtacccgttactaccccggaaacttaccgttacgtaacgttaaccgtaaccgtaaccgtaacgttacggtaacgtttaacgttaacctacctttaaaccgttacttaccggttaacgtaactaaccggttaaaggttaacccgttaacgtaccccgtttacccaccgttccttaacgggtcccgttaccggggtacggaaaccgaggtacggtacggtacaacgttacggaaaccgttagtcgggtaacnccgtancccgagttacgtctaacggttctacccgttccg

SEQ ID NO: 71014 - DNA, 684 bp, Homo sapiens
  misc_feature: GYAE6OF02FH2ZS.3.19.B08.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (677)..(677): a, c, t, g, unknown or other
  misc_feature (677)..(677): n is a, c, g, or t
tcagagacgcactccacgaccggtgctcgatttagtgagtcagtaagggggagccagtctcagtcaggacacagcatggacatgagggtccccgctcagctcctggggctcctgctactctggctccgagatcgccagatgtgacacccagatcgacccagtctccatccctccctgtctgcctatctggtgganacagngtcatcattcctctcggccgganaagtcgagtattgttattattattaattggtactnacgttacaaacgtaggaacncctanctacctnactcatcgtcncgactactacctaagtttaacgaacggtcgggtcctaacgtacggtaacggtacctaaggtcggtacgtaggttacggtacgtcggtaacggacgtaacgttacgtttacctaccgttaccgtaaccgtaacccttagttaccgtaacgtttacgtaacccgttaaaccgttaccgtaaggttaaaccttgttttaaccgaaccgtttaacgttaacctaggttactaaccaaagttacggttaacctaacgtaccctacccgttacccgacttcggttaccgtcgggaccggtaacggtaccggtaacggagtacacggtacctaaacggtccgtaggccgtacgtacggcctaactacgtacctgttacccgtnttacccg

SEQ ID NO: 71015 - DNA, 742 bp, Homo sapiens
  misc_feature: GYAE6OF02JIWR5.3.19.B08.1.454.CMB.1.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (295)..(295): a, c, t, g, unknown or other
  misc_feature (295)..(295): n is a, c, g, or t
  modified_base (373)..(373): a, c, t, g, unknown or other
  misc_feature (373)..(373): n is a, c, g, or t
tcagagacgcactccacgaccggtgctcgatttagtgagtcagtaagggggagccagtctcagtcaggacacagcatggacatgagggtccccgctcagctccgtggggctcctgctactctggctccgagatcgccagatgtcgaccacccagatcgacccagtctccactcctccctgtctgacntcgtggtgganacagatcatcacttctcgtacggccgganaacgtcagtnttgttattatttacttaagttgtatcgtattaccaacgaggaacctccctagcctcgngtacttcgatcgctgacctactactaagtttaacgaacggttccggtacctagtacgtaacggttcgaggtcgtaagnggtaggtagtacgtcggtatacgtttctcctaccgtactaccaacgtacgttacctaaggttacccttaaccgtaaccgtaaaccgtttaggtaaacgttttcgtttaaccgaaaccccttttaaacgttaacgtttaccccggttaaataacccggtaaacttacgggtttaaaacccttaacccgttaaccccggtttccccccttaaccggtaccgtttcccggtttaaacccggttcccggggtaacgggtaaacccgttaaccgggtaaggtacccggtacgtaaaccgtaaccggtaaccggttacttacggcgggttacacgtacccctacgttccgttacgtcgtttaccgtcctacccgg

SEQ ID NO: 71016 - DNA, 374 bp, Homo sapiens
  misc_feature: GYAE6OF01CQLJE.44.17.B06.1.454.CMB.1.raw
  modified_base (367)..(374): a, c, t, g, unknown or other
  misc_feature (367)..(374): n is a, c, g, or t
tcagacagtatatacacgaccggtgctcgatttagtcgatagtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgcctccaggagcacctctgggggcacagcggccctgggctgcctggtcaaggactacttcctatatactgtctgagcgggctggcaaggcgcatagnnnnnnnn

SEQ ID NO: 71017 - DNA, 400 bp, Homo sapiens
  misc_feature: GYAE6OF01EUFZW.44.17.B06.1.454.CMB.1.raw
  modified_base (397)..(400): a, c, t, g, unknown or other
  misc_feature (397)..(400): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgcccctgctccaggagcacctctggggcacagcggccctgggctgcctggtcaaggactacttccacgtctactgctgagcggctggcaaggcgcatagnnnn

SEQ ID NO: 71018 - DNA, 309 bp, Homo sapiens
  misc_feature: GYAE6OF01BFZPR.44.17.B06.1.454.CMB.1.raw
  modified_base (182)..(182): a, c, t, g, unknown or other
  misc_feature (182)..(182): n is a, c, g, or t
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (300)..(309): a, c, t, g, unknown or other
  misc_feature (300)..(309): n is a, c, g, or t
tcagacagtatatacacgaccggtgctcgatttagtcgatagtgaaggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtcagcccaaggccaacccntgtcactctgttcccacctctctatatactgtctgagcgggctggcaaggcgcatagnnnnnnnnnn

SEQ ID NO: 71019 - DNA, 463 bp, Homo sapiens
  misc_feature: GYAE6OF01C2QHP.44.17.B06.1.454.CMB.1.raw
  modified_base (299)..(299): a, c, t, g, unknown or other
  misc_feature (299)..(299): n is a, c, g, or t
  modified_base (446)..(463): a, c, t, g, unknown or other
  misc_feature (446)..(463): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaaatgaacagtctgagagccgaggacacggctgtgtattactgtgcaagagccggtgcgggagttcggggattgcatactactactacggtatggacgtctgggggaccaaagggccacggtccaccgtctcctcagcttccaccaaggccatcggtcttcccctggccnccctcgcctccaggacgcaccgtcgtcggggcacgacgccggcccgtgggccgtcgccgtcggtaccaaacgggaccttaccgttcccgacgttcctaacgtcgcgttcggacgggccgggcgtcgggacaacgggcgctagtacgnnnnnnnnnnnnnnnnnn

SEQ ID NO: 71020 - DNA, 399 bp, Homo sapiens
  misc_feature: GYAE6OF01E4VKI.44.17.B06.1.454.CMB.1.raw
  modified_base (396)..(399): a, c, t, g, unknown or other
  misc_feature (396)..(399): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccagagcacctctggggcacagcggccctgggctgcctggtcaaggactacttcctatatactgtctgagcgggctggcaaggcgcatagnnnn

SEQ ID NO: 71021 - DNA, 589 bp, Homo sapiens
  misc_feature: GYAE6OF01CY6R4.44.17.B06.1.454.CMB.1.raw
  modified_base (298)..(298): a, c, t, g, unknown or other
  misc_feature (298)..(298): n is a, c, g, or t
  modified_base (418)..(418): a, c, t, g, unknown or other
  misc_feature (418)..(418): n is a, c, g, or t
tcagacagtatatacacgaccggtgctcgatttagtcgatagtgaaggggggggtcacaagaggcagcgctctcgggacgtctccaccatggcctgggctctgctgctcctcactctcctcactcaggacacagggtcctgggcccagtctgccctgactcagcctgcctccgtgtctgggtcgcctggacagtcggtcaccatcctcctgcactggacgccagtcggtaatattcttagtcttaactttgtctcctggtatcaacatcatccaaggtaacaccccaatcatcatctntgagcctataagacgccctgtagggttactaagtcgcttcactcgcctcgaacgtccgacaaccgaccgtccctccctagacatcctcgtcgggcctaccgaggtcgtaggacgggacgnggacttagtatttatttattgttcgctcgtagtagttcgttcgtcgctatctattagtcgttacgttacggaaggtcgggaaccgtacggtccaccggttccgtaaggtcctaccggaccccgaacggtacccctaaaccccgtacgtcgtaccctcttcccgttaccccg

SEQ ID NO: 71022 - DNA, 399 bp, Homo sapiens
  misc_feature: GYAE6OF01DK7EE.44.17.B06.1.454.CMB.1.raw
  modified_base (388)..(388): a, c, t, g, unknown or other
  misc_feature (388)..(388): n is a, c, g, or t
  modified_base (394)..(399): a, c, t, g, unknown or other
  misc_feature (394)..(399): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaaggcccatcggtcttccccctggcgccctgctccaggagcacctctggggcacagcggccctggctgcctggtcaaggactacttcctatatactgtctgagcggctggcaaggcncatagnnnnnn

SEQ ID NO: 71023 - DNA, 743 bp, Homo sapiens
  misc_feature: GYAE6OF01BRQAB.44.17.B06.1.454.CMB.1.raw
tcagacagtatatacacgaccggtgctcgatttagtcgatagtgaagggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcggtcaccatcctcctgcacgtggacgccaggtccggttaaatactttcgttaaggttcttttaaacttttcgtccttccttggtactcaacactcaatccaaggtaaaccgccccctaaactcatctactctatgacggtacctaagtaacgacgtccctacgtacgggtttactaagtcgtaccttcaacgtcgaccctaccgaacgtccggacgaaccgtaccggtcccctacccgtacgaacctaactccttaccgtcgggtccttccgaggtcgtaggacgggacggtacggtcttagtacttttaagtttattttggttacgtcttacgtaaggttacgtttcgggtttaccggtcgtacttaacgttccgttaaacgtttagttcggtttaccggttacggggtaacggtacggggtaaacccgtaacgggttacccgtaaccccggttccgttaacgggtacccacccggaaccccgtaaaccgggacccccctaaacccggtaccttaccggttaccctacctttcccggtttaacccccg

SEQ ID NO: 71024 - DNA, 674 bp, Homo sapiens
  misc_feature: GYAE6OF01BWYE2.44.17.B06.1.454.CMB.1.raw
  modified_base (245)..(245): a, c, t, g, unknown or other
  misc_feature (245)..(245): n is a, c, g, or t
tcagacagtatatacacgaccggtgctcgatttagtcgatagtgaaggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctctgcactggactcagcagtgagctacacttctaatgtcncctctgtatacaacacactcccggaccaaacccccaatctgacttcatagaatctactaacgcgccctgtggtactttgtagtacttcgctttctcgtcggtcctccgtacggtccggccaaccgtaccgtccctccgtacgaacctaacttccgtacgtccgggcctccgagtcccgtaggaggacgaggtaacttaagttcgtttacttcgtttacctactaatttactaccgttacgtttcgtttgggttttcgggttacggggtttccgttacggggtaccgggtaacggggtacccggtagggttaccgttaacccggttcgttacgggtaccgaccggacccggttaacgggcccttacccgggtccccccgttaccggtacctacccgttaccgtcccgttcccccgtaaccccgtttcccg

SEQ ID NO: 71025 - DNA, 746 bp, Homo sapiens
  misc_feature: GYAE6OF01DZMDN.44.17.B06.1.454.CMB.1.raw
  modified_base (246)..(246): a, c, t, g, unknown or other
  misc_feature (246)..(246): n is a, c, g, or t
tcagacagtatatacacgaccggtgctcgatttagtcgatagtgaagggggggtcacaagaggcagcgctctcgggacgtctccaccatggcctgggctctgctgctcctcactctcctcactcaggacacagggtcctgggcccagtctcgccctgactcagcctgcctccgtgtctgggtatccgtggacagtcgatccaccttcctcctgccacgtggacctcagcagtgagctactaacttntaatcgtcgccttcgtgtactaccaaacaaccacgtccccggaacctaaaaaccccccccaaacttccttagtaactttcaagttaacgaaacttctactaacggcccggtccctcgtagggtactttccgtgtacttccgtctttctcgtggacccttccgacggttacccggacctaaacccgtacccggtccctacccgtacgtaaacctaacttccgtcgtaccgggcccttccgaacgtccgttaagggacggaacggaagggttaacctttaattacttttccgtcgtttacctcgtaattactacgttaccgtttcgtttgggtttcgggtttacgggttcggttaccgggtacggggacgggtaccgggtaagggttcccgtaccggggtccttacgggtacccgtacggtaccccgagggttcccctcccgggtcccccttaccgggtccctacgttcccggtttaccccgttccccgtccctttaccccg

SEQ ID NO: 71026 - DNA, 612 bp, Homo sapiens
  misc_feature: GYAE6OF01BCGGY.44.17.B06.1.454.CMB.1.raw
tcagacagtatatacacgaccggtgctcgatttagtcgatagtgaagggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgagctcaacttcttaatgtcgcctcctggtatcaacaacatcccggacaaaccccccaaactcttgacttcatgaaatctctaagcgccctctgggatttctgactcgcttctctggctccaggtccggacaaccgacggtccctccctgacaactcctcgtgggtcctccgacgcctggacggacgagactaaattactttctcgttcctactattactactacgttcgtttaggttcggtttacgggttcgtttcgggacgggtaacgggaccggtaggtccggacccgttaccgtagggtccgacgtcccgaacggtcctaccggcccccccgttacggtccctaccgttaccgttcccggttccccctaccccgtttaccccg

SEQ ID NO: 71027 - DNA, 546 bp, Homo sapiens
  misc_feature: GYAE6OF01ADDSO.44.17.B06.1.454.CMB.1.raw
  modified_base (178)..(178): a, c, t, g, unknown or other
  misc_feature (178)..(178): n is a, c, g, or t
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (472)..(472): a, c, t, g, unknown or other
  misc_feature (472)..(472): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (518)..(519): a, c, t, g, unknown or other
  misc_feature (518)..(519): n is a, c, g, or t
  modified_base (523)..(523): a, c, t, g, unknown or other
  misc_feature (523)..(523): n is a, c, g, or t
  modified_base (525)..(526): a, c, t, g, unknown or other
  misc_feature (525)..(526): n is a, c, g, or t
  modified_base (528)..(528): a, c, t, g, unknown or other
  misc_feature (528)..(528): n is a, c, g, or t
  modified_base (531)..(535): a, c, t, g, unknown or other
  misc_feature (531)..(535): n is a, c, g, or t
  modified_base (537)..(537): a, c, t, g, unknown or other
  misc_feature (537)..(537): n is a, c, g, or t
  modified_base (539)..(544): a, c, t, g, unknown or other
  misc_feature (539)..(544): n is a, c, g, or t
  modified_base (546)..(546): a, c, t, g, unknown or other
  misc_feature (546)..(546): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagngccggtgcgggtagttcggggagttgacatacctactacgtacggtatcggacgtcgnggggaccaagggccacggtcaccgtctcctcagcttccaccacggcccagtcgtcttccccgngccgcctcgctccgaggcnccaccgtcgtggggccacgtacggccggccgtcggctacgccgtcggtaccgaacggtaccttacttcccgtaattaacgtaccgttgtccgtagggtacggtccgggtacgttacgggaccgtaacgggccgacgtacgttagccgatcggcngacgcacgcgagcgancgcgtacncgcgacacgacgagcncanacnngcgngnngngcnnnnncncnnnnnngn

SEQ ID NO: 71028 - DNA, 525 bp, Homo sapiens
  misc_feature: GYAE6OF01DDSWP.44.17.B06.1.454.CMB.1.raw
  modified_base (195)..(195): a, c, t, g, unknown or other
  misc_feature (195)..(195): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (484)..(484): a, c, t, g, unknown or other
  misc_feature (484)..(484): n is a, c, g, or t
  modified_base (488)..(525): a, c, t, g, unknown or other
  misc_feature (488)..(525): n is a, c, g, or t
tcagacagtatatacacgaccggtgctcgatttagtcgatagtgaagggagtagcacaagctacgcggactccgtgaagggccattcaccatctccagagacaacgccaaagaacacgctgtatctgcaaaatgaaacagtctgagagccgaggacacggctgtgtattactgtgacaagaggccggtggcgggnggtttcggggattgcataactctaacgtacggtatggaacgtcgtcggggaccaaaggggacccacgggtacctaccggtcctcccttacacgtccttacccgaaccgaacggggcccaacgttcggtcccttcccccgtggccgccctcggcctaccgaggacgccaccgtcggtcgggggcacgtagccggccgtgggacctcgccgtggtacgtaaacggtacttaccttccgcgtacgtccgcggtcgtggacggccggtcgtgggacaacggcganacgancangcannnnnnnnnnnnnnnnnnnnnnnnnnnnnnnnnnnnnn

SEQ ID NO: 71029 - DNA, 517 bp, Homo sapiens
  misc_feature: GYAE6OF01B6IZU.44.17.B06.1.454.CMB.1.raw
  modified_base (143)..(143): a, c, t, g, unknown or other
  misc_feature (143)..(143): n is a, c, g, or t
  modified_base (480)..(480): a, c, t, g, unknown or other
  misc_feature (480)..(480): n is a, c, g, or t
  modified_base (483)..(483): a, c, t, g, unknown or other
  misc_feature (483)..(483): n is a, c, g, or t
  modified_base (486)..(517): a, c, t, g, unknown or other
  misc_feature (486)..(517): n is a, c, g, or t
tcagacagtatatacacgaccggtgctcgatttagtcgatagtgaagggagtagcacaagctacgcggactccgtgaagggccgattcaccatctccagagacaacgccaaagaacacgctgtatctgacaaatgaacagtcngagagccgaggacacggctgtgtattactgtgacaagagccgggtggcgggtagttcggggagttgcatactactactacgggtatgggacgttcgtgggggacccaaagggcccacgggtaccacccgttctcctcgacgcttacccaaccgaaagggccccctaagtccggttcccttccccccgtggcccgccccttagcctaccgaggacgccaccctaccgagacgaccacgacggccgcccgtgggcctgccgtcggtacaaggtaccttacgttacctataatacctggtcctagggacggcgggctacgggcgtaaggcgacaagtgcngcngtnnnnnnnnnnnnnnnnnnnnnnnnnnnnnnnn

SEQ ID NO: 71030 - DNA, 415 bp, Homo sapiens
  misc_feature: GYAE6OF01ECUU5.44.17.B06.1.454.CMB.1.raw
  modified_base (303)..(303): a, c, t, g, unknown or other
  misc_feature (303)..(303): n is a, c, g, or t
  modified_base (397)..(415): a, c, t, g, unknown or other
  misc_feature (397)..(415): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtctggggccaagggaccacggtcaccgtctcctcagcttccacagggcccatcgtctcccctgcgccctgctcaggncactcgtggggcacagccggcctgggctgccgtggtcaaggtctacgttcctatactacgtgtctggcgcgggctgggctaagggcgacatagnnnnnnnnnnnnnnnnnnn

SEQ ID NO: 71031 - DNA, 828 bp, Homo sapiens
  misc_feature: GYAE6OF01D9IAQ.44.17.B06.1.454.CMB.1.raw
  modified_base (319)..(319): a, c, t, g, unknown or other
  misc_feature (319)..(319): n is a, c, g, or t
  modified_base (391)..(391): a, c, t, g, unknown or other
  misc_feature (391)..(391): n is a, c, g, or t
tcagacagtatatacacgaccggtgctcgatttagtcgatagtgaagggggggtcacaagaggcagcgctctcgggacgtctccaccatggcctgggctctgctgctcctcactctcctcactcaggacacgacggtcctgggcccagtctcgcctgactcacgcctccgtcgtgccggtctccgtggacagtcacgtcacatcctccgtagccaacgtacggaaaacccaagtagttcggaccgtttccggtttcgtttttgacccgtttggttcccttaccgtacggtaccacgccaaccggacccaagtaaaaccnccgaacccctaatcttaacgtttattacgttcgacgtactagttccgttcccgccctttacggcgttcccgngtaccggtctccttacgtcggttacgacgtacgtcacggacctaaccgccggtccctttacccgacgtacctctcccggttagttccggggacctaccgtaggggacccgtcgggaagggtacccggtacgggtacgtttaacgttaacgtttaaccgttaaccgttcgtaccgtacgtaccgttacgtaacttaacgtaaccggttaaacggtaacgggttaacctttaacgtttaccgttaacgggttccgggtaaccgtacgggtaaccggtaacgtaaccgtaccggttaccggtaaccggttaccggttaaccgggtaccgtaacccggttaacccggaaccgggttccccgtacccccgggttaccccggttcccgtacccgttcccgttacccgtttaccctaacccccgttcccgtaccctttaacccg

SEQ ID NO: 71032 - DNA, 664 bp, Homo sapiens
  misc_feature: GYAE6OF01B2RPZ.44.17.B06.1.454.CMB.1.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
tcagacagtatatacacgaccggtgctcgatttagtcgatagtgaaggggggggtcacaagaggcagcgctctcggaacgtctccaccatggcctgggctctgctgctcctcactctcctcactcaggacacaggggtcctgggcccagtctcgccctgactcagcctcgccttccgtgtcgtgggtactccgtggacngtcgatcctacctttcncctagctacgttcggactcgacgctacggtaggacggtccttaccttaaactttcttaagtcgtaccgccttcgtaggtactacaaaccactaacgtaccccgaaccctaaaccccctaaacttcgttacgacttanactagtaactctaacgtacgtccgtcctgtggttacttncgtctcgtcttctcgtcgcctacgcggtccgacacggccgtcctacgcgtactacgttctcgcgtcctacgcgtcgacggtaacggacgtacgtaactttaatcttttcgctttaccattaactagttaccgttagtttcgttagggtttggtacggtttcgtaaggggcggtacgggtcgtcggtacgtcgtacgtacggtcggaccgtacgacggtcccttacccggccccgtggtaccctacggttcccgttcttccccggtcctttcg

SEQ ID NO: 71033 - DNA, 804 bp, Homo sapiens
  misc_feature: GYAE6OF01D3W9V.44.17.B06.1.454.CMB.1.raw
  modified_base (219)..(219): a, c, t, g, unknown or other
  misc_feature (219)..(219): n is a, c, g, or t
tcagacagtatatacacgaccggtgctcgatttagtcgatagtgaagggggggtcacaagaggcagcgctctcgggacgtctccaccatgggcctgggctctgctgctcctcactctcctcactcgaggacacacgggtcctcggctcagttcgtgcccgtgcctcacgcccttccctcggtcgttccgggtctccgtggacctagtcacgtccacctntccctctgcctacgacggaaacacgtcgtcggaccggttcggttcgtttagccgtcgtctaccgtcggtaccagaccgtacgaaccccaacgaaaccaccgaacccccctaaattacctagtttacttacgtacgtcggtacttaacgtccgttccgtcccgttcgtccgtcgtacgtcgccgtacgtccgtacgtcggtaccgtacgtcggtccgtacctccgtcgtacccgtcctcccggtacgtccactccgtacggtaccggtccctaccggtaacggtacgtacgtaagggtacggtacggttagggtaactttaagtaaccttcgtacccgtaaccggttacgttacgtacgtacgaaccgacggtcaaccgtcggtacgtttaggggtttccggggttggggttaacccgggttaccggggaacgggtacccgggtaaccggtaacggtaccgttacccgggtccgggttaccggtcccggggtaaccgcccgggttacccggtacggtaccccgttcccccgggtaacggttcccccggtaacccgttcccggtttacccgtccccggttacccccg

SEQ ID NO: 71034 - DNA, 404 bp, Homo sapiens
  misc_feature: GYAE6OF02GWIWH.44.17.B06.1.454.CMB.1.raw
  modified_base (398)..(404): a, c, t, g, unknown or other
  misc_feature (398)..(404): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnnn

SEQ ID NO: 71035 - DNA, 404 bp, Homo sapiens
  misc_feature: GYAE6OF02G8U4J.44.17.B06.1.454.CMB.1.raw
  modified_base (397)..(404): a, c, t, g, unknown or other
  misc_feature (397)..(404): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttccacgtctactgctgagcgggcgtgcaaggcgcatagnnnnnnnn

SEQ ID NO: 71036 - DNA, 826 bp, Homo sapiens
  misc_feature: GYAE6OF02IYA3U.44.17.B06.1.454.CMB.1.raw
tcagacagtatatacacgaccggtgctcgatttagtcgatagtgaagggggggtcgacgaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctacaacttctaatgtcgcctcctggtatcaacaacatcccggacaaacccccaactcttgacttcatgaaactctactaagccggtaccctcgtgggacttttcgtagtactccgtctttctcgtcggtccttaccgtacgggttcccggacaaaccgtaccgggcccttaccccgtaggaacctaaacttccttaccggtcgggtccttacccgaacggcccgttacggaacgggtaccgaacgggtaaccttaaaaagtttacgtttttccgttacggttttaccccttactaactttaacgttaaccgtaaccggtttaccgtttttacgggttttcgggggtttttacggggttcccgttttaccgggggaccgggggttaaacggggtaccccggttaagggggttcccggttaaccccgggttacccgggtttaacggggtttacccgaaacccggttaccccgggtaaaacggggttccccgtttaccccggggttccccccccggtttacggggttaacccccttaacccggttttccccgtttcccggggttttaccccccccggtcccccgttttaacccccgg

SEQ ID NO: 71037 - DNA, 598 bp, Homo sapiens
  misc_feature: GYAE6OF02GIF9Q.44.17.B06.1.454.CMB.1.raw
  modified_base (438)..(438): a, c, t, g, unknown or other
  misc_feature (438)..(438): n is a, c, g, or t
tcagacagtatatacacgaccggtgctcgatttagtcgatagtgaaggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacactcccgaccaaacccccaactcttgacttcatagaatctactaacgccgcctcgtgggtactttctgactcgtcttctctcggctccgacggtccgacaacgaccggccctcccgtgaccaactcctcgtcgggcctccgacgtccgtggacggacgacggtactaaattntttctcgttcctctatactactacgttcttggtttcggttgggttcgttcgggacggtacgggtaccggtaggtcgtaccgtcgtaggtccgacggaccgtaacggtcctccgtccccgtcggtcctaccgttccgttccggttccccgtcccttacccg

SEQ ID NO: 71038 - DNA, 546 bp, Homo sapiens
  misc_feature: GYAE6OF02GFXFS.44.17.B06.1.454.CMB.1.raw
  modified_base (355)..(355): a, c, t, g, unknown or other
  misc_feature (355)..(355): n is a, c, g, or t
  modified_base (400)..(400): a, c, t, g, unknown or other
  misc_feature (400)..(400): n is a, c, g, or t
tcagacagtatatacacgaccggtgctcgatttagtcgatagtgaaggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggacaaaccccccaactcttgattcatgaaatctctaagcggccctctgggatttctgatcgcttctctgctcaggtccgcacncgcctcctgacatctctggctccagcctgaggacgaggctaaatntttctgttcctctatatacacgttcttgttggttggtcgttcgggcggtacgggccgaggtcgaccgtccgtaggtcacggtcccgaacggcctaccggcccccgttcgggtcctaccgttccgtccgttccccgtccccttcccg

SEQ ID NO: 71039 - DNA, 606 bp, Homo sapiens
  misc_feature: GYAE6OF02JTTZQ.44.17.B06.1.454.CMB.1.raw
  modified_base (536)..(536): a, c, t, g, unknown or other
  misc_feature (536)..(536): n is a, c, g, or t
tcagacagtatatacacgaccggtgctcgatttagtcgatagtgaaggggggtcggacgaagaggcagcactctcgggacgtctccaccatggcctgggctctactcctcctcagcctcctcactcagggcacaggtcctgggactgtctaccctgactcagccgccctcagtgtccgggactcctggtcagtcggtcaccatcttctgttcttccagcgacaattccactggccctttaaagctctatcatggtacgcagtggtccggcgagccccaaagtcctctttacgacgtcctttcgcggtcttcggcagtccctggccgtttttcggcctccagttctgacctacgcggcctcctgaccatccaccaaactccggcctgacggatgagctcgacttacttttgtgtcgtctattactttcgtaactttcaacgttccaaaatttatcgttactttacgggaaagttcggggaaccctcgttcgaagtccgtccttacggcgttcgacgccctaaggcccctaaaccccncttgtctactccgttcggttcccccccttcccgttctataccttacgtgttcctaggtacgaccggggtc

SEQ ID NO: 71040 - DNA, 535 bp, Homo sapiens
  misc_feature: GYAE6OF02GTL5N.44.17.B06.1.454.CMB.1.raw
tcagacagtatatacacgaccggtgctcgatttagtcgatagtgaagggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggcaaaccccccaaactcttgattcatgaaatctctaagcggccctctgggattttctgatcgcttctctggctccaggtccggcaacacggcctccctgacaatctctcgggctccagcctgaggacgaggctaaatatttctgtttcctcattactactacgtcttgttggttggttcttcggcgggtaggaccgaggtcgaccgtccgtaggtccgagcccaaggctcgccccgtggtccactcgtcgttcccgcccttccc

SEQ ID NO: 71041 - DNA, 673 bp, Homo sapiens
  misc_feature: GYAE6OF02F4T4V.44.17.B06.1.454.CMB.1.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
tcagacagtatatacacgaccggtgctcgatttagtcgatagtgaagggggggtcacaagaggcagcgctctcgggacgtctccaccatggcctgggctctgctgctcctcactctcctcactcaggacacagggtcctgggcccagtctgccctgactcagcctgcctccgtgtctgggtactccgtggacagtcgatcctaccttctcctgcacgtggactcagcagtgaggctcaactttctaatgtcncctcgtgtatcaacaacncgtcccggaccaaacccccaactcttgattcatacgaactctactaacgccggtccctcgtgggtatttctgtactcgtcttctctgtcctcgtacggtccgacaaccgaccggtccctccgtagacctaacttccgtcgttcggtcctaccgtacgtaccgtaggaacggtacggaacggtactaaacttacgtttacgttcgttacctactacttacttacctacgttcgtttacggtttcggtttacgggttcgttacgggtacgggtacgggaccggtacggtaccggtaccgttacgtacggtcgacggtacccgtaagggtacccccccccccgtaggttacccccgttccggttacccgtaccgttccgtcccgttaccccgtaccccgttacccg

SEQ ID NO: 71042 - DNA, 465 bp, Homo sapiens
  misc_feature: GYAE6OF02ILE8S.44.17.B06.1.454.CMB.1.raw
  modified_base (423)..(424): a, c, t, g, unknown or other
  misc_feature (423)..(424): n is a, c, g, or t
  modified_base (426)..(427): a, c, t, g, unknown or other
  misc_feature (426)..(427): n is a, c, g, or t
  modified_base (429)..(429): a, c, t, g, unknown or other
  misc_feature (429)..(429): n is a, c, g, or t
  modified_base (431)..(465): a, c, t, g, unknown or other
  misc_feature (431)..(465): n is a, c, g, or t
tcagacagtatatacacgaccggtgctcgatttagtcgatagtgaaggggagtagcacaagctacgcggactccgtgaagggccgattcaccatctccagagacaacgcccaagaaccacgctgtatctgcaaaatgaacagtctgagagccgaggacacggctgtgtattactgtgcaagagccggtggcgggagttcggggattgcatactactactacggtatgggacgtcgtggggccaaggggaccacggtcaccgtctcctcacgctccaccgaacgggccatcggtctcccccgtggcgccctgctccgaggacgcacctcgtcggggcacgacgccggcccgtgggcctgcctggcaacggtctacttctatactactcgtctagacgcgggcgtcggcgaaggcgctagtagtnncnncngnnnnnnnnnnnnnnnnnnnnnnnnnnnnnnnnnnn

SEQ ID NO: 71043 - DNA, 488 bp, Homo sapiens
  misc_feature: GYAE6OF02G805K.44.17.B06.1.454.CMB.1.raw
  modified_base (300)..(300): a, c, t, g, unknown or other
  misc_feature (300)..(300): n is a, c, g, or t
  modified_base (462)..(488): a, c, t, g, unknown or other
  misc_feature (462)..(488): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtcgtggggccaagggaccacggtcaccgtctcctcagcttccaccaagggcccatcggtcttccccctggccnccctgcctccgaggacgccacccgtcgtcgggggaccacgacgccggtaccccgtggggcctcggcccttcgggtaccgaaacggtaccttaccgttccttaacttacttacctggttccttaggaggccgggtctcgggacgaacggccgacgataggcannnnnnnnnnnnnnnnnnnnnnnnnnn

SEQ ID NO: 71044 - DNA, 809 bp, Homo sapiens
  misc_feature: GYAE6OF02H1V0S.44.17.B06.1.454.CMB.1.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
tcagacagtatatacacgaccggtgctcgatttagtcgatagtgaaggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgctactggactnagcagtgngcctacaactttcttaatcgtcgtccttccgtggtactacaacaacacgtccccggaccaaacccctaacctacttcgtagttactacgtacgtaagtacttactacgtaccggtacccgttccgttacggttacggtttacttagtacgttacgttcctttaccgtttccgttcggtccgttacccggtaccggtacccgggtaccgtaaccgtaaccgtccccgttacccgtacctaccggtaacttacgtccgtaccggtcccggtccctacgtaccgtacggtaggaacgggtaccggtaacgttaaaccgtttaacgtttacccgttttcgtttacccgttaccttaagttaaccgttaaaccgttaccgttaccgtttcgggtttacgggtttcgggtttccggttccgggttacggggtaccggggaccggttaacgggttcggtacccgtttacccggttacggttaaccggaccggttacccggaaccggttaccggttccccgtaccccggttacccggtcccgttaacccgttcccttaccccggtttcccccgttacccgttaccccg

SEQ ID NO: 71045 - DNA, 462 bp, Homo sapiens
  misc_feature: GYAE6OF02JCUS5.44.17.B06.1.454.CMB.1.raw
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (435)..(462): a, c, t, g, unknown or other
  misc_feature (435)..(462): n is a, c, g, or t
tcagacagtatatacacgaccggtgctcgatttagtcgatagtgaaggtagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggattgcatactactactacggtatggacgtcgtgggggccaaagggccacggtcaccgtctccgtcagccttccaccaagggccccatcggtcccttccccctcggccgtccctcgacctccgaggacgcctacccgtcgtcgggggcacgagccggcccgtgggctcgccgtcggtacaacggacctacttcctattatactcgtctgacgcgggtctggacgagggcgnatagngnnnnnnnnnnnnnnnnnnnnnnnnnnnn

SEQ ID NO: 71046 - DNA, 673 bp, Homo sapiens
  misc_feature: GYAE6OF02IL5EK.44.17.B06.1.454.CMB.1.raw
tcagacagtatatacacgaccggtgctcgatttagtcgatagtgaaggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcacgtggactcagcaggtgacggctcaactttcttaatgtcgcctcctggtactacaacaacactccccggaccaaaacccccccaaacttccttagtacttacatagaactctacgtaacgccggtcccttcgtgggtacttttcgtgtactccgtactttctcgttcggtcctccgacggtccggacgaaccgtacccggtcccttaccctacgaacctaacttcgttccgtcgggtacctccgacgtccgtaggacggacgaggtacttaaattacgtttctacgttcctactacttactaccgtacgttcgtttacgggtttgggtttcggttcgttcggggtcgggtacgggaccggtacgggtccgtaccgtcgtacggtcgaacggtcccgaacggtcctcccggtaccccgttcggtaccgtaccgttccgtacccgttccccgtaccccttacg

SEQ ID NO: 71047 - DNA, 684 bp, Homo sapiens
  misc_feature: GYAE6OF02I70XI.44.17.B06.1.454.CMB.1.raw
tcagacagtatatacacgaccggtgctcgatttagtcgatagtgaagggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatccaccttctcctgcactggactcagcagtgacgctacaacttctaatcgtccgcctcctggtactacaacaacacgtcccggaccaaacccccctaatcttagacttacatagtaaacttcctacgtaacgcccggtacccgttcgtcgggttactttctacgacttccgtcctttcgtcgtcggtcctccgtaacggttccgaccaaccgtaccggtcccctcccgtagtaacctacttcctccggtcgggcctccgacgtccgtacggacgggtacgagtacttaaacttcttacgttgttaccctgtaactactacgttacgttccttttaggtttcgggtttcggttccggttcgggcgggtacgggtaccggtaggtaccggtcccgttacgtaggtacccgaacggtacccggacggtcccgttccgcccccgttacgggtccttacccggtccttaccccgtttcccctaccccgttacc

SEQ ID NO: 71048 - DNA, 619 bp, Homo sapiens
  misc_feature: GYAE6OF02JPI2A.44.17.B06.1.454.CMB.1.raw
  modified_base (329)..(329): a, c, t, g, unknown or other
  misc_feature (329)..(329): n is a, c, g, or t
  modified_base (496)..(496): a, c, t, g, unknown or other
  misc_feature (496)..(496): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (555)..(556): a, c, t, g, unknown or other
  misc_feature (555)..(556): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (572)..(573): a, c, t, g, unknown or other
  misc_feature (572)..(573): n is a, c, g, or t
  modified_base (581)..(581): a, c, t, g, unknown or other
  misc_feature (581)..(581): n is a, c, g, or t
  modified_base (599)..(601): a, c, t, g, unknown or other
  misc_feature (599)..(601): n is a, c, g, or t
  modified_base (611)..(611): a, c, t, g, unknown or other
  misc_feature (611)..(611): n is a, c, g, or t
  modified_base (614)..(614): a, c, t, g, unknown or other
  misc_feature (614)..(614): n is a, c, g, or t
  modified_base (618)..(619): a, c, t, g, unknown or other
  misc_feature (618)..(619): n is a, c, g, or t
tcagacagtatatacacgaccggtgctcgatttagtcgatagtgaagggagtagcacaagctacgcggactccgtgaagggccgattcaccatctccagagacaacgccaaagaacaacgctgtatctgcaaatgaaacagtctagagagccgaaggacacggctgtgtattactgtgacaagagccggtggcgggagtttcggggattgcagtaactactacgtaacgtatcgggactcgtacgggacaaagggtcccaaggtccaccggtctaccgtcaacgtccttaccaacgaacgggtcccaagttccgtccccttacccccgnggcccgtacccttcgccgtaccgaggaccgaccctacccgtcggtacggggacctaacgccggtacccggtccggtcgggcctaccggccgtcggaaccaacgggtaccttaccgtaccgtaaaccggtttctaaccgttggtactaacgggacggtccgggtaacncggggtaacaacggtccgtacgtagtaacgctagcacgctaacgcgacgngaacncgannagacgcgcncgtnacnncgacgcgntacgagcacgcgcagcannnacagcacgancgngacnn

SEQ ID NO: 71049 - DNA, 714 bp, Homo sapiens
  misc_feature: GYAE6OF02HH96B.44.17.B06.1.454.CMB.1.raw
  modified_base (196)..(196): a, c, t, g, unknown or other
  misc_feature (196)..(196): n is a, c, g, or t
tcagacagtatatacacgaccggtgctcgatttagtcgatagtgaaggggggggtcacaagaggcagcgctctcgggacgtctccaccatggcctgggctctgctgctcctcactctcctcactcaggacacgagggtcctgggcccagtctgccctgactcagcctgcctccgtgtcgtgggtactccgtggacngtcatcctaccttctcctgcctacgtggacctcagctaggtgacgtcctactaactttctaagtcgtccgtcctaccgttaggtactacaaaccactaccgtcccccggaacccaaacccccctaagttcttagaacttcctaagtaacgtaaacttctaaccgtaacggcccgtccgttcggtacgggttactttcgtagtcgttccgttcttcgtcgtcggcctaccggtacgggtccgaacctaaccggacccggtccctacctacgtactacgttcgtccgtacggtcctaccgcgtacgtaggacgggaacgtagtaccttaagttcgtttctcgttacctacgtaactactacgtcgtttcgtttaggttcggttcgggttcggttccgggacgggtacgggtaccggtaggtccgtaacccgtcgttacggacccgacggtacccggtaacggtcccgttcccggccccgttacgtcctccgtttcccgtcccgttccccgtcccttaccg

SEQ ID NO: 71050 - DNA, 665 bp, Homo sapiens
  misc_feature: GYAE6OF02G3D1Q.44.17.B06.1.454.CMB.1.raw
  modified_base (268)..(268): a, c, t, g, unknown or other
  misc_feature (268)..(268): n is a, c, g, or t
tcagacagtatatacacgaccggtgctcgatttagtcgatagtgaaggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctacaacttctaatcgtcgcctctggtatccaacaacnctaccccggaccaaaacccccctaatcttagacttcatacaatctactaacgccgccctcgtggtactttctagactcgtcttctcgtcggctccgtacggtccgactaacgccgccctccacgtaactacgtccgtcgtcggtcctccgtagacccgtggaacggacgtaacgtaacttaaactttacgtttcgttacgttaccttactaacttacgtacctacgtttacgtttggtttcgggtttcgggttcggttacgggtacgggtacgggtaccggtagggtaccgtacccggttaccgtacggtaccgaacggtacccggtaacggtccgtaccccgtccccggttacggtccctaccgttcccgttcccggttcccccgtcccttacccg

SEQ ID NO: 71051 - DNA, 557 bp, Homo sapiens
  misc_feature: GYAE6OF02GJ8IF.44.17.B06.1.454.CMB.1.raw
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
  modified_base (518)..(521): a, c, t, g, unknown or other
  misc_feature (518)..(521): n is a, c, g, or t
  modified_base (523)..(557): a, c, t, g, unknown or other
  misc_feature (523)..(557): n is a, c, g, or t
tcagacagtatatacacgaccggtgctcgatttagtcgatagtgaagggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtcgtggggccaagggaccacggtcaccgtctcctcacgtccttccaccgaacgggcccctagttccggtcccttccccccgtgggcccgtcccctgtccctccgagggacgccgtacccttcgggtcgggggaccaccgacgggtccccggccccgtcggggtcctcggtcccgtcggggtaccgaaacgggtacctttaccgttccccgtaaccgtttccttacgtcgtcgttaggacgggccggggtccgtacgggaccgtaaagggcccgacgaggttgcgcngtngnnnngnnnnnnnnnnnnnnnnnnnnnnnnnnnnnnnnnnn

SEQ ID NO: 71052 - DNA, 209 bp, Homo sapiens
  misc_feature: GYAE6OF01DNLHR.18.21.B10.1.454.CMB.1.raw
  modified_base (205)..(209): a, c, t, g, unknown or other
  misc_feature (205)..(209): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaagagcacctctggggcacagcggccctgggctgcctggtcaaggactacttcccatactcgtactgagcgggctggcaaggcgcatagnnnnn

SEQ ID NO: 71053 - DNA, 281 bp, Homo sapiens
  misc_feature: GYAE6OF01A9CYC.18.21.B10.1.454.CMB.1.raw
  modified_base (237)..(240): a, c, t, g, unknown or other
  misc_feature (237)..(240): n is a, c, g, or t
  modified_base (243)..(281): a, c, t, g, unknown or other
  misc_feature (243)..(281): n is a, c, g, or t
tcagtacgagtatgcacgaccggtgctcgatttagtgtcgtcgcaagaggtaggaggggtggaggctggaggatgttggagtttattactgcagtcgcaaggtacacactgggccgctcacgctcggcggagggaccagggtggagatgaaacgaactgtggctgcaccatctgtcttcatccttcccgccatcctgacatactcgtactgagcgggctggcaagggcacagtaagnnnntannnnnnnnnnnnnnnnnnnnnnnnnnnnnnnnnnnnnnn

SEQ ID NO: 71054 - DNA, 226 bp, Homo sapiens
  misc_feature: GYAE6OF01DTZBS.18.21.B10.1.454.CMB.1.raw
  modified_base (225)..(226): a, c, t, g, unknown or other
  misc_feature (225)..(226): n is a, c, g, or t
tcagtacgagtatgcacgaccggtgctcgatttagtgtcgtcgcaagaggagaggggtggaggctgaggatgttggagtttattactgcatgcaaggtacacactggccgctcacgctcggcggaggaccagggtggagatgaaacgaactgtggctgcaccatctgtcttcatcttcccgccatctgacatactcgtactgagcgggctggcaaggcgcatagnn

SEQ ID NO: 71055 - DNA, 209 bp, Homo sapiens
  misc_feature: GYAE6OF01D1I3P.18.21.B10.1.454.CMB.1.raw
  modified_base (207)..(209): a, c, t, g, unknown or other
  misc_feature (207)..(209): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcgggctggcaaggcgcatagnnn

SEQ ID NO: 71056 - DNA, 210 bp, Homo sapiens
  misc_feature: GYAE6OF01D5JXW.18.21.B10.1.454.CMB.1.raw
  modified_base (206)..(210): a, c, t, g, unknown or other
  misc_feature (206)..(210): n is a, c, g, or t
tcagtacgagtatgcacgaccggtgctcgatttagtgtcgtcgcaaggggaccacggtcatcgtttcgtcggcctccaccaagggcccatcggtcttcccctggcaccctgctccaggagcacctccgagagcacagcggccctgggctgcctggtcaaggactacttcccatactcgtactgagcgggctggcaaggcgcatagnnnnn

SEQ ID NO: 71057 - DNA, 208 bp, Homo sapiens
  misc_feature: GYAE6OF01E3TAJ.18.21.B10.1.454.CMB.1.raw
  modified_base (206)..(208): a, c, t, g, unknown or other
  misc_feature (206)..(208): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctggggcacagcggccctgggctgcctggtcaaggactacttcccatactcgtactgagcgggctggcaaggcgcatagnnn

SEQ ID NO: 71058 - DNA, 207 bp, Homo sapiens
  misc_feature: GYAE6OF01DERY4.18.21.B10.1.454.CMB.1.raw
  modified_base (207)..(207): a, c, t, g, unknown or other
  misc_feature (207)..(207): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcgggctggcaaggcgcatagn

SEQ ID NO: 71059 - DNA, 245 bp, Homo sapiens
  misc_feature: GYAE6OF01CQ095.18.21.B10.1.454.CMB.1.raw
  modified_base (213)..(214): a, c, t, g, unknown or other
  misc_feature (213)..(214): n is a, c, g, or t
  modified_base (216)..(221): a, c, t, g, unknown or other
  misc_feature (216)..(221): n is a, c, g, or t
  modified_base (223)..(245): a, c, t, g, unknown or other
  misc_feature (223)..(245): n is a, c, g, or t
tcagtacgagtatgcacgaccggtgctcgatttagtgtcgtcgcaagggaccacggtcatccgtttcgtcggcctcctaccaagggccctatcggtcttcccctggcaccctcctccaagagcacctctgggggccacagcggtccctgggctgcctggtctaaggactacttcccattactcgtactgagcgggctggcaaggcgcagtagnngnnnnnngnnnnnnnnnnnnnnnnnnnnnnn

SEQ ID NO: 71060 - DNA, 208 bp, Homo sapiens
  misc_feature: GYAE6OF01D5BF0.18.21.B10.1.454.CMB.1.raw
  modified_base (207)..(208): a, c, t, g, unknown or other
  misc_feature (207)..(208): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcgggctggcaaggcgcatagnn

SEQ ID NO: 71061 - DNA, 208 bp, Homo sapiens
  misc_feature: GYAE6OF01ATC9O.18.21.B10.1.454.CMB.1.raw
  modified_base (205)..(208): a, c, t, g, unknown or other
  misc_feature (205)..(208): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaagagcacctctggggcacagcggccctgggctgcctggtcaaggactacttcccatactcgtactgagcgggctggcaaggcgcatagnnnn

SEQ ID NO: 71062 - DNA, 237 bp, Homo sapiens
  misc_feature: GYAE6OF01BUCZ8.18.21.B10.1.454.CMB.1.raw
  modified_base (225)..(237): a, c, t, g, unknown or other
  misc_feature (225)..(237): n is a, c, g, or t
tcagtacgagtatgcacgaccggtgctcgatttagtgtcgtcgcaagagaggaggggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcgggctggcaaggcgcatagnnnnnnnnnnnnn

SEQ ID NO: 71063 - DNA, 221 bp, Homo sapiens
  misc_feature: GYAE6OF01E01X9.18.21.B10.1.454.CMB.1.raw
  modified_base (206)..(221): a, c, t, g, unknown or other
  misc_feature (206)..(221): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggctacttcccatactcgtactgagcgggctggcaaggcgcatagnnnnnnnnnnnnnnnn

SEQ ID NO: 71064 - DNA, 208 bp, Homo sapiens
  misc_feature: GYAE6OF01DPYUZ.18.21.B10.1.454.CMB.1.raw
  modified_base (206)..(208): a, c, t, g, unknown or other
  misc_feature (206)..(208): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaagagcacctctgggggcacagcggccctgggctgcctggtcaaggactacttcccatactcgtactgagcgggctggcaaggcgcatagnnn

SEQ ID NO: 71065 - DNA, 249 bp, Homo sapiens
  misc_feature: GYAE6OF01CAFW3.18.21.B10.1.454.CMB.1.raw
  modified_base (213)..(249): a, c, t, g, unknown or other
  misc_feature (213)..(249): n is a, c, g, or t
tcagtacgagtatgcacgaccggtgctcgatttagtgtcgtcgcaagggaccacggtcgatcgtttcgtcggcctccaccaaggggcccatcggtcttccccctggcaccctcctccaacgagcacctcttgggggcacagcggccctgggctgcctggtcaacggacgtacttcccatactcgtactcgagcgggctggcaaggcgcatagnnnnnnnnnnnnnnnnnnnnnnnnnnnnnnnnnnnnn

SEQ ID NO: 71066 - DNA, 259 bp, Homo sapiens
  misc_feature: GYAE6OF01DE0G0.18.21.B10.1.454.CMB.1.raw
  modified_base (139)..(139): a, c, t, g, unknown or other
  misc_feature (139)..(139): n is a, c, g, or t
  modified_base (234)..(235): a, c, t, g, unknown or other
  misc_feature (234)..(235): n is a, c, g, or t
  modified_base (238)..(259): a, c, t, g, unknown or other
  misc_feature (238)..(259): n is a, c, g, or t
tcagtacgagtatgcacgaccggtgctcgatttagtgtcgtcgcaagagaggaggggtggaggctgaggatgttggagtttattactgcatgcaaggtacacactggccgctcacgctcggcggaggaccagggtgganatgaaacgaactgtggctgcaccatctgtcttcattcttccccgcaatctgacctatacctcgtactgagcgggctggcaaaggcgactaatagnncannnnnnnnnnnnnnnnnnnnnn

SEQ ID NO: 71067 - DNA, 210 bp, Homo sapiens
  misc_feature: GYAE6OF01CF2X0.18.21.B10.1.454.CMB.1.raw
  modified_base (206)..(210): a, c, t, g, unknown or other
  misc_feature (206)..(210): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttccatactcgtactgagcgggctggcaaggcgcatagnnnnn

SEQ ID NO: 71068 - DNA, 206 bp, Homo sapiens
  misc_feature: GYAE6OF01BV8R0.18.21.B10.1.454.CMB.1.raw
  modified_base (206)..(206): a, c, t, g, unknown or other
  misc_feature (206)..(206): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctggggcacagcggccctgggctgcctggtcaaggactacttcccatactcgtactgagcgggctggcaaggcgcatagn

SEQ ID NO: 71069 - DNA, 210 bp, Homo sapiens
  misc_feature: GYAE6OF01DZQ3M.18.21.B10.1.454.CMB.1.raw
  modified_base (207)..(210): a, c, t, g, unknown or other
  misc_feature (207)..(210): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcgggctggcaaggcgcatagnnnn

SEQ ID NO: 71070 - DNA, 218 bp, Homo sapiens
  misc_feature: GYAE6OF01EJ2XT.18.21.B10.1.454.CMB.1.raw
  modified_base (207)..(218): a, c, t, g, unknown or other
  misc_feature (207)..(218): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcgggctggcaaggcgcatagnnnnnnnnnnnn

SEQ ID NO: 71071 - DNA, 267 bp, Homo sapiens
  misc_feature: GYAE6OF01AUIW8.18.21.B10.1.454.CMB.1.raw
  modified_base (211)..(212): a, c, t, g, unknown or other
  misc_feature (211)..(212): n is a, c, g, or t
  modified_base (214)..(267): a, c, t, g, unknown or other
  misc_feature (214)..(267): n is a, c, g, or t
tcagtacgagtatgcacgaccggtgctcgatttagtgtcgtcgcaaggggaccacggtcaagtcgtttcgtcggcctccaccaagggcccatcggtcttccccctggcaccctcctcccaagagcacctctggggggcacagcggccctgggctgcctggtcaaggactacttcccatactcgtactgagcgggctggcaaggcgcatagnngnnnnnnnnnnnnnnnnnnnnnnnnnnnnnnnnnnnnnnnnnnnnnnnnnnnnnn

SEQ ID NO: 71072 - DNA, 209 bp, Homo sapiens
  misc_feature: GYAE6OF01BLJTD.18.21.B10.1.454.CMB.1.raw
  modified_base (206)..(209): a, c, t, g, unknown or other
  misc_feature (206)..(209): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctggggcacagcggccctgggctgcctggtcaaggactacttcccatactcgtactgagcgggctggcaaggcgcatagnnnn

SEQ ID NO: 71073 - DNA, 208 bp, Homo sapiens; identical to SEQ ID NO: 71060
  misc_feature: GYAE6OF01BCM8Y.18.21.B10.1.454.CMB.1.raw
  modified_base (207)..(208): a, c, t, g, unknown or other
  misc_feature (207)..(208): n is a, c, g, or t

SEQ ID NO: 71074 - DNA, 206 bp, Homo sapiens
  misc_feature: GYAE6OF01AZTCK.18.21.B10.1.454.CMB.1.raw
  modified_base (205)..(206): a, c, t, g, unknown or other
  misc_feature (205)..(206): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctggggcacagcggccctgggctgcctggtcaggactacttcccatactcgtactgagcgggctggcaaggcgcatagnn

SEQ ID NO: 71075 - DNA, 212 bp, Homo sapiens
  misc_feature: GYAE6OF01ALOGF.18.21.B10.1.454.CMB.1.raw
  modified_base (207)..(212): a, c, t, g, unknown or other
  misc_feature (207)..(212): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcgggctggcaaggcgcatagnnnnnn

SEQ ID NO: 71076 - DNA, 224 bp, Homo sapiens
  misc_feature: GYAE6OF01CXNF8.18.21.B10.1.454.CMB.1.raw
  modified_base (204)..(224): a, c, t, g, unknown or other
  misc_feature (204)..(224): n is a, c, g, or t
tcagtacgagtatgcacgaccggtgctcgatttagtgtcgtcgcaaggggaccgacggtcatcgtttcgtcggcctccaccaagggcccatcggtcttcccctggcaccctcctccaagagcacctctggggcacagcggccctgggctgcctggtcaaggctacttcccatactcgtactgagcggctggcaaggcgcatagnnnnnnnnnnnnnnnnnnnnn

SEQ ID NO: 71077 - DNA, 212 bp, Homo sapiens; identical to SEQ ID NO: 71075
  misc_feature: GYAE6OF01B65A5.18.21.B10.1.454.CMB.1.raw
  modified_base (207)..(212): a, c, t, g, unknown or other
  misc_feature (207)..(212): n is a, c, g, or t

SEQ ID NO: 71078 - DNA, 207 bp, Homo sapiens
  misc_feature: GYAE6OF01DBDVH.18.21.B10.1.454.CMB.1.raw
  modified_base (206)..(207): a, c, t, g, unknown or other
  misc_feature (206)..(207): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaagagcacctctgggggcacagcggccctgggctgcctggtcaaggactacttcccatactcgtactgagcgggctggcaaggcgcatagnn

SEQ ID NO: 71079 - DNA, 211 bp, Homo sapiens
  misc_feature: GYAE6OF01EE62G.18.21.B10.1.454.CMB.1.raw
  modified_base (207)..(211): a, c, t, g, unknown or other
  misc_feature (207)..(211): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcgggctggcaaggcgcatagnnnnn

SEQ ID NO: 71080 - DNA, 211 bp, Homo sapiens; identical to SEQ ID NO: 71079
  misc_feature: GYAE6OF01DJMSI.18.21.B10.1.454.CMB.1.raw
  modified_base (207)..(211): a, c, t, g, unknown or other
  misc_feature (207)..(211): n is a, c, g, or t

SEQ ID NO: 71081 - DNA, 257 bp, Homo sapiens
  misc_feature: GYAE6OF01APRJP.18.21.B10.1.454.CMB.1.raw
  modified_base (210)..(211): a, c, t, g, unknown or other
  misc_feature (210)..(211): n is a, c, g, or t
  modified_base (213)..(215): a, c, t, g, unknown or other
  misc_feature (213)..(215): n is a, c, g, or t
  modified_base (217)..(219): a, c, t, g, unknown or other
  misc_feature (217)..(219): n is a, c, g, or t
  modified_base (221)..(257): a, c, t, g, unknown or other
  misc_feature (221)..(257): n is a, c, g, or t
tcagtacgagtatgcacgaccggtgctcgatttagtgtcgtcgcaaggggaccacggtcatccgtttcgtcggcctccaccaagggcccatcggtcttccccctggcaccctcctccaagagcacctctgggggcacagcggtccctgggctgcctggtctaaggctacttcccatactcgtactgagcgggctggcaaggcgcagtagnngnnngnnngnnnnnnnnnnnnnnnnnnnnnnnnnnnnnnnnnnnnn

SEQ ID NO: 71082 - DNA, 212 bp, Homo sapiens; identical to SEQ ID NO: 71075
  misc_feature: GYAE6OF01CY442.18.21.B10.1.454.CMB.1.raw
  modified_base (207)..(212): a, c, t, g, unknown or other
  misc_feature (207)..(212): n is a, c, g, or t

SEQ ID NO: 71083 - DNA, 213 bp, Homo sapiens
  misc_feature: GYAE6OF01CWRUR.18.21.B10.1.454.CMB.1.raw
  modified_base (205)..(213): a, c, t, g, unknown or other
  misc_feature (205)..(213): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaagagcacctctgggggcacagcggccctgggctgcctggtcaaggactacttcccatactcgtactgagcggctggcaaggcgcatagnnnnnnnnn

SEQ ID NO: 71084 - DNA, 209 bp, Homo sapiens
  misc_feature: GYAE6OF01DW8FT.18.21.B10.1.454.CMB.1.raw
  modified_base (206)..(209): a, c, t, g, unknown or other
  misc_feature (206)..(209): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggcctgggctgcctggtcaaggactacttcccatactcgtactgagcgggctggcaaggcgcatagnnnn

SEQ ID NO: 71085 - DNA, 225 bp, Homo sapiens
  misc_feature: GYAE6OF01B08BB.18.21.B10.1.454.CMB.1.raw
  modified_base (206)..(225): a, c, t, g, unknown or other
  misc_feature (206)..(225): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggctacttcccatactcgtactgagcgggctggcaaggcgcatagnnnnnnnnnnnnnnnnnnnn

SEQ ID NO: 71086 - DNA, 603 bp, Homo sapiens
  misc_feature: GYAE6OF01CFLNM.18.21.B10.1.454.CMB.1.raw
  modified_base (126)..(126): a, c, t, g, unknown or other
  misc_feature (126)..(126): n is a, c, g, or t
  modified_base (284)..(284): a, c, t, g, unknown or other
  misc_feature (284)..(284): n is a, c, g, or t
  modified_base (286)..(287): a, c, t, g, unknown or other
  misc_feature (286)..(287): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (341)..(342): a, c, t, g, unknown or other
  misc_feature (341)..(342): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
tcagtacgagtatgcacgaccggtgctcgatttagtgtcgtcgcaagtaggagagggggtggagggctccggacggtagttcgttgggtagttttattactgtcgatgcaaggtacacactggccnctcaacgctcggcggagggaccgagggttggagatagaaacgtacgttgtggtctgtactaacgattcctagttcttcgagttccttcccgacattcgtgactagtacggtcgtacgttggacggcgggtcgtggggaccaagggccgactacgtagngnngnctganttcactgnttatctgatctnancgtgcagctcagngtacgangnctnngtanatagactagtntagatanatctagtanactactactagtagagagatagtactactactactacgtacgtacgtactaacgtacgtacgactactacgtacgtacgttacgtaacgtagacgacgtcgtacgtagtcgtagtacgacggacgacgtcgtctagtaccgttagttaggtggtagggtaaggtaacggtaaggtaaggttaacggttacgggttaacggttagggttacgggtcgggtacgggtacggg

SEQ ID NO: 71087 - DNA, 271 bp, Homo sapiens
  misc_feature: GYAE6OF01BPTJ9.18.21.B10.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
  modified_base (239)..(271): a, c, t, g, unknown or other
  misc_feature (239)..(271): n is a, c, g, or t
tcagtacgagtatgcacgaccggtgctcgatttagtgtcgtcgcaagagaggaggggtggaggctgaggatgttggagtttattactgcatgcaaggtacacacgtggccgctcacgctcggcggaggacgagggtggagataggaaaccgaattgtggctgcactagtctgtcttcattccttcccgctatcgngaacatacgtcgtactggacgcggcnggacgaaggcgacaatgnnnnnnnnnnnnnnnnnnnnnnnnnnnnnnnnn

SEQ ID NO: 71088 - DNA, 229 bp, Homo sapiens
  misc_feature: GYAE6OF01E3Z1A.18.21.B10.1.454.CMB.1.raw
  modified_base (207)..(229): a, c, t, g, unknown or other
  misc_feature (207)..(229): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctggctgcctggtcaaggactacttcccatactcgtaactgagcgggctggcaaggcgcatagnnnnnnnnnnnnnnnnnnnnnnn

SEQ ID NO: 71089 - DNA, 293 bp, Homo sapiens
  misc_feature: GYAE6OF01AY2V3.18.21.B10.1.454.CMB.1.raw
  modified_base (134)..(134): a, c, t, g, unknown or other
  misc_feature (134)..(134): n is a, c, g, or t
  modified_base (244)..(244): a, c, t, g, unknown or other
  misc_feature (244)..(244): n is a, c, g, or t
  modified_base (251)..(293): a, c, t, g, unknown or other
  misc_feature (251)..(293): n is a, c, g, or t
tcagtacgagtatgcacgaccggtgctcgatttagtgtcgtcgcaaagagagaggggtggaggctgaggatgttggagttttattactgcatgacaaggtacacactggccgctcacgctcgggcggagggacnggggtgagatagaaacgaatggtggctgacactatctagtccttcatccttcccgctatctgaactattacctccggtaatgggaggccgggtactagggaccaaaggcncaagtgnnnnnnnnnnnnnnnnnnnnnnnnnnnnnnnnnnnnnnnnnnn

SEQ ID NO: 71090 - DNA, 205 bp, Homo sapiens
  misc_feature: GYAE6OF02I0MY1.18.21.B10.1.454.CMB.1.raw
  modified_base (204)..(205): a, c, t, g, unknown or other
  misc_feature (204)..(205): n is a, c, g, or t
tcagtacgagtatgcacgaccggtgctcgatttagtgtcgtcgcaagggaccacggtcatcgtttcgtcggcctccaccaagggcccatcggtcttcccctggcaccctcctccaagagcacctctggggcacagcggccctgggctgcctggtcaaggactacttcccatactcgtactgagcgggctggcaaggcgcatagnn

SEQ ID NO: 71091 - DNA, 206 bp, Homo sapiens
  misc_feature: GYAE6OF02F52ZN.18.21.B10.1.454.CMB.1.raw
  modified_base (204)..(206): a, c, t, g, unknown or other
  misc_feature (204)..(206): n is a, c, g, or t
tcagtacgagtatgcacgaccggtgctcgatttagtgtcgtcgcaagggaccacggtcatcgtttcgtcggcctccaccaagggcccatcggtcttcccctggcaccctcctccaagagcacctctggggcacagcggccctgggctgcctggtcaaggactacttcccatactcgtactgagcgggctggcaaggcgcatagnnn

SEQ ID NO: 71092 - DNA, 220 bp, Homo sapiens
  misc_feature: GYAE6OF02H5P8Q.18.21.B10.1.454.CMB.1.raw
  modified_base (204)..(220): a, c, t, g, unknown or other
  misc_feature (204)..(220): n is a, c, g, or t
tcagtacgagtatgcacgaccggtgctcgatttagtgtcgtcgcaagggaccacggtcatcgtttcgtcggcctccaccaagggcccatcggtcttcccctggcaccctcctccaagagcacctctggggcacagcggccctgggctgcctggtcaaggactacttcccatactcgtactgagcgggctggcaaggcgcatagnnnnnnnnnnnnnnnnn

SEQ ID NO: 71093 - DNA, 258 bp, Homo sapiens
  misc_feature: GYAE6OF02GFKHQ.18.21.B10.1.454.CMB.1.raw
  modified_base (214)..(258): a, c, t, g, unknown or other
  misc_feature (214)..(258): n is a, c, g, or t
tcagtacgagtatgcacgaccggtgctcgatttagtgtcgtcgcaagggaccacggtcgatcgtttcgtcggcctccaccaagggcccatcgggtcttcccctggccaccctcctccaagacgcacctctggggctacagcggccctgggcctgcctggtcaaggacgtacttcccatactcgtactgagtcgggcttggcaaggcgcattagnnnnnnnnnnnnnnnnnnnnnnnnnnnnnnnnnnnnnnnnnnnnn

SEQ ID NO: 71094 - DNA, 206 bp, Homo sapiens; identical to SEQ ID NO: 71068
  misc_feature: GYAE6OF02F7K4A.18.21.B10.1.454.CMB.1.raw
  modified_base (206)..(206): a, c, t, g, unknown or other
  misc_feature (206)..(206): n is a, c, g, or t

SEQ ID NO: 71095 - DNA, 207 bp, Homo sapiens
  misc_feature: GYAE6OF02FVKBQ.18.21.B10.1.454.CMB.1.raw
  modified_base (205)..(207): a, c, t, g, unknown or other
  misc_feature (205)..(207): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaagagcacctctggggcacagcggccctgggctgcctggtcaaggactacttcccatactcgtactgagcgggctggcaaggcgcatagnnn

SEQ ID NO: 71096 - DNA, 203 bp, Homo sapiens
  misc_feature: GYAE6OF02H4L07.18.21.B10.1.454.CMB.1.raw
  modified_base (203)..(203): a, c, t, g, unknown or other
  misc_feature (203)..(203): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaagagcacctctggggcacagcggccctgggctgcctggtcaaggatacttcccaactcgtactgagcgggctggcaaggcgcatagn

SEQ ID NO: 71097 - DNA, 207 bp, Homo sapiens
  misc_feature: GYAE6OF02GRMQ9.18.21.B10.1.454.CMB.1.raw
  modified_base (206)..(207): a, c, t, g, unknown or other
  misc_feature (206)..(207): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctggggcacagcggccctgggctgcctggtcaaggactacttcccatactcgtactgagcgggctggcaaggcgcatagnn

SEQ ID NO: 71098 - DNA, 209 bp, Homo sapiens
  misc_feature: GYAE6OF02JEGE9.18.21.B10.1.454.CMB.1.raw
  modified_base (204)..(209): a, c, t, g, unknown or other
  misc_feature (204)..(209): n is a, c, g, or t
tcagtacgagtatgcacgaccggtgctcgatttagtgtcgtcgcaagggaccacggtcatcgtttcgtcggcctccaccaagggcccatcggtcttcccctggcaccctcctccaagagcacctctggggcacagcggccctgggctgcctggtcaaggactacttcccatactcgtactgagcgggctggcaaggcgcatagnnnnnn

SEQ ID NO: 71099 - DNA, 233 bp, Homo sapiens
  misc_feature: GYAE6OF02FYE63.18.21.B10.1.454.CMB.1.raw
  modified_base (225)..(233): a, c, t, g, unknown or other
  misc_feature (225)..(233): n is a, c, g, or t
tcagtacgagtatgcacgaccggtgctcgatttagtgtcgtcgcaagagaggaggggtggaggctgaggatgttggagtttattactgcatgcaaggtacacactggccgctcacgctcggcggagggaccagggtggagatgaaacgaactgtggctgcaccatctgtcttcatcttcccgcatctgacatactcgtactgagcgggctggcaaggcgcatagnnnnnnnnn

SEQ ID NO: 71100 - DNA, 209 bp, Homo sapiens; identical to SEQ ID NO: 71072
  misc_feature: GYAE6OF02GRXP6.18.21.B10.1.454.CMB.1.raw
  modified_base (206)..(209): a, c, t, g, unknown or other
  misc_feature (206)..(209): n is a, c, g, or t

SEQ ID NO: 71101 - DNA, 222 bp, Homo sapiens
  misc_feature: GYAE6OF02FWRBU.18.21.B10.1.454.CMB.1.raw
  modified_base (206)..(222): a, c, t, g, unknown or other
  misc_feature (206)..(222): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctggggcacagcggccctgggctgcctggtcaaggactacttcccatactcgtactgagcgggctggcaaggcgcatagnnnnnnnnnnnnnnnnn

SEQ ID NO: 71102 - DNA, 238 bp, Homo sapiens
  misc_feature: GYAE6OF02FYX3G.18.21.B10.1.454.CMB.1.raw
  modified_base (208)..(238): a, c, t, g, unknown or other
  misc_feature (208)..(238): n is a, c, g, or t
tcagtacgagtatgcacgaccggtgctcgatttagtgtcgtcgcaaggggaccgacggtcatcgtttcgtcggcctccaccaagggcccatcggtcttccccctggcacccctcctccaagacgcacctctggggcacagcgccctgggctgcctggtcaaggactacttcccatactcgtactgagcgggctggcaaggcgcatagnnnnnnnnnnnnnnnnnnnnnnnnnnnnnnn

SEQ ID NO: 71103 - DNA, 247 bp, Homo sapiens
  misc_feature: GYAE6OF02FZFEF.18.21.B10.1.454.CMB.1.raw
  modified_base (212)..(247): a, c, t, g, unknown or other
  misc_feature (212)..(247): n is a, c, g, or t
tcagtacgagtatgcacgaccggtgctcgatttagtgtcgtcgcaaggggaccacggtcatcggtttcgtcggcctccaccaaggggcccagtcggtcttccccctggcaccctcctccaagagcacctctggggctacagcggccctgggctggcctggtcaaggactacttcccagtactcgtactgagcgggctggcaaggcgcatagnnnnnnnnnnnnnnnnnnnnnnnnnnnnnnnnnnnn

SEQ ID NO: 71104 - DNA, 239 bp, Homo sapiens
  misc_feature: GYAE6OF02G6IS1.18.21.B10.1.454.CMB.1.raw
  modified_base (204)..(239): a, c, t, g, unknown or other
  misc_feature (204)..(239): n is a, c, g, or t
tcagtacgagtatgcacgaccggtgctcgatttagtgtcgtcgcaagggaccgacggtcatcgtttcgtcggcctccaccaagggcccatcggtcttccccctggcaccctcctccaagacgcacctctggggcacagcgccctgggctgcctggtcaaggctacttccatactcgtactgagcgggctggcaaggcgcatagnnnnnnnnnnnnnnnnnnnnnnnnnnnnnnnnnnnn

SEQ ID NO: 71105 - DNA, 217 bp, Homo sapiens
  misc_feature: GYAE6OF02JJAIM.18.21.B10.1.454.CMB.1.raw
  modified_base (206)..(217): a, c, t, g, unknown or other
  misc_feature (206)..(217): n is a, c, g, or t
tcagtacgagtatgcacgaccggtgctcgatttagtgtcgtcgcaaggggaccacggtcatcgtttcgtcggcctccaccaagggcccatcggtcttcccctggcaccctcctccaacgagcacctctggggcacagcggccctgggctgcctggtcaaggactacttcccatactcgtactgagcgggctggcaaggcgcatagnnnnnnnnnnnn

SEQ ID NO: 71106 - DNA, 254 bp, Homo sapiens
  misc_feature: GYAE6OF02FJ909.18.21.B10.1.454.CMB.1.raw
  modified_base (209)..(254): a, c, t, g, unknown or other
  misc_feature (209)..(254): n is a, c, g, or t
tcagtacgagtatgcacgaccggtgctcgatttagtgtcgtcgcaaggggaccacgggtcatcgtttcgtcggcctccaccaagggcccatcggtcttccccctggcacccctcctccaagagcacctctgggggcacagcggccctgggcctgcctggtcaggctacttcccagtactcgtactgagcgggctggcaaggcgcatagnnnnnnnnnnnnnnnnnnnnnnnnnnnnnnnnnnnnnnnnnnnnnn

SEQ ID NO: 71107 - DNA, 217 bp, Homo sapiens
  misc_feature: GYAE6OF02INEDD.18.21.B10.1.454.CMB.1.raw
  modified_base (206)..(217): a, c, t, g, unknown or other
  misc_feature (206)..(217): n is a, c, g, or t
tcagtacgagtatgcacgaccggtgctcgatttagtgtcgtcgcaaggggaccacggtcatcgtttcgtcggcctccaccaagggcccatcggtcttccccctggcaccctcctccaagagcacctctgggggcacagcggccctgggctgcctggtcaaggactacttcccatactcgtactgagcggctggcaaggcgcatagnnnnnnnnnnnn

SEQ ID NO: 71108 - DNA, 220 bp, Homo sapiens
  misc_feature: GYAE6OF02HMUS3.18.21.B10.1.454.CMB.1.raw
  modified_base (200)..(200): a, c, t, g, unknown or other
  misc_feature (200)..(200): n is a, c, g, or t
  modified_base (206)..(209): a, c, t, g, unknown or other
  misc_feature (206)..(209): n is a, c, g, or t
  modified_base (211)..(220): a, c, t, g, unknown or other
  misc_feature (211)..(220): n is a, c, g, or t
tcagtacgagtatgcacgaccggtgctcgatttagtgtcgtcgcaaggggaccacggtcatcgtttcgtcggcctccaccaagggcccatcggtcttccccctggcaccctctccaagagcacctctggggcacagcggccctgggctgcctggtcaaggctacttcccatacctcgtactgagcgggctggcaagggcncatagnnnncnnnnnnnnnn

SEQ ID NO: 71109 - DNA, 492 bp, Homo sapiens
  misc_feature: GYAE6OF01A6WAF.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaacctcctgatctatgctgcagccactttgcaaagtgagtcccatcgagttcagtggcagtggtctgggacagatttctctctcaccattagcagtctgcaacctgaagtattttgctaacttactactagtcaactagtagttacaatttgccctatcactttcggaccaagggacacggactaggagaattaaacgactagtgctgac

SEQ ID NO: 71110 - DNA, 501 bp, Homo sapiens
  misc_feature: GYAE6OF01A3WS0.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacgcccctaacctcctgatctatgctgcagccatttgcaaagtgatcccatcgaggttcagtgcagtggtctgggacagtatttctctctcacctattagctagtctgcaacctgaagtattttgctaacttactactgtacaactagtagttaacaatttcgaccctatcctactttcggacctaagggacacggactggaatattaaacgactagtcggctgac

SEQ ID NO: 71111 - DNA, 509 bp, Homo sapiens
  misc_feature: GYAE6OF01DGI6B.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacgccctaacctcctgatctatgctgcagccactttgcaaagtggagtcccatcgagttcagtggcagtggtctgggacagtatttctctctcacctattagcagtctgctaacctgaagtattttgactaacttactactgtacaactagtagttactaatttcgaccctatctacctttcggaccgtaagggaccacgacgtaggagtaacttaaacgaactgtcgctgacc

SEQ ID NO: 71112 - DNA, 533 bp, Homo sapiens
  misc_feature: GYAE6OF01CYS5D.51.32.C10.1.454.CMB.1.raw
  modified_base (277)..(277): a, c, t, g, unknown or other
  misc_feature (277)..(277): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacncccctaacctcctgatctatgctgcagtcactttgacaaagtgagtccatcgagttcagtggcagtggtntgggacngtatttcncttctcacctattagctagtctgactaacctgaagtattttgactaactttactactgtacaatagtaacgttactaatttcgaccctatacctacgtttccggaccgtaaacgggacctaacgacgttaggaagtaacttaaaaccggactaggttacggcgttggaccc

SEQ ID NO: 71113 - DNA, 617 bp, Homo sapiens
  misc_feature: GYAE6OF01DVVDS.51.32.C10.1.454.CMB.1.raw
  modified_base (222)..(222): a, c, t, g, unknown or other
  misc_feature (222)..(222): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcacatcacttgccggnaagacagaacatggcagctaatttaattgtatcagacaagaaaccaggaaacgcccctaacctcctgtatctatgctgcacgtcctactttagactaaaggtcggaacgtacccgagtcggtaggttcgaggtggcgtaggtggtcgtagggactagtactttccgtctacgtcacctattacgctacgtcgtacgactaaccgtgtaacgttattttacgaacttaaacctttaaccgttacgttacgtaacaaacgtaaggtaacttttaactaacgttttcgaaccctattaccgttaccgtttaccgggaacccgtaagggtaacctaaccggtacgttagggaaacttaaacggttaaaaccgtacgttaggttcggtactcgtaacccg

SEQ ID NO: 71114 - DNA, 543 bp, Homo sapiens
  misc_feature: GYAE6OF01CXS7U.51.32.C10.1.454.CMB.1.raw
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccggcaagacagaacatggcagactatttaaatggtgtcagcagaaaccaggtaaacgcccctaacctcctgatctatgctgcagcctactttgcaaagtggacgtcccatcgagttcagtggcaggtgggtctgggacagtatttcnctctcaacctattagcagtctgacaactgaatntttgactaaccttactactgtacaaactagaagttactaatttcgaccctatcctaccgtttcggacctaaaggggtaccaacggtacgtacgggtaaagtaaacgtttaaaaccggaacgttaggtacggtcgttacgacccg

SEQ ID NO: 71115 - DNA, 545 bp, Homo sapiens
  misc_feature: GYAE6OF01BPYLI.51.32.C10.1.454.CMB.1.raw
  modified_base (277)..(277): a, c, t, g, unknown or other
  misc_feature (277)..(277): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaancccctaactcctgatctatgctgcagccactttgcaaagtggatcccatcgaggttcagtggcagtgggtctgggacagtatttctctctcacctattagctagtctgactaacctgaagtattttgactaactttactactgtacaactagtagtttacaatttcgacccctattcctaccttttccgggaccctaaaggggtacccaacggtaccgtagggaacgtaacgtttaaaaccggaacttgggtacggtcgtcggtaccc

SEQ ID NO: 71116 - DNA, 606 bp, Homo sapiens
  misc_feature: GYAE6OF01AP7W3.51.32.C10.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttggccggnaagacagaacattggcagctaatttaatggtatcagcaagaaaccagggaaacncccctaactcctagactctatcgctgcagcctattgacaaagtgactccatcgagttcagtgcagtggtctgggactagtactttcgctctacactagttagctagttcagacctaaaccgttggaacgttattttacggaccttaaactttacgtactacggttaccaaacgtaggtaacgtttaactaacgtttccgaccccttaagttcccgtaaccgttttaccggaacccgtaaaaggggtacctaaccgggtaacgttacggggtaaaacttaaacgtttaaaaacccgggactttagggtaccgggtacttacgggaaccc

SEQ ID NO: 71117 - DNA, 572 bp, Homo sapiens
  misc_feature: GYAE6OF01AENXN.51.32.C10.1.454.CMB.1.raw
  modified_base (276)..(276): a, c, t, g, unknown or other
  misc_feature (276)..(276): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaatggtatcagcagaaaccgagggaacncccctaacctctgactctatcgctgcagcctacttgactaaagtcggactcccagtcgtaggttcaggtggcgtaggtgggtctggggactaggtactttcgtctctacacctattacgctagtctacgactaaccgtgaagttatttcgacttaactttactactagtacaacgtagtacgttacaagtttccgaccctattccgtacgtttaccggaccgtaacgggacctacggtacgtacgggtaaacgtaaacgtttaaaaccggacgttagggtcggtcgtcggtaaccc

SEQ ID NO: 71118 - DNA, 516 bp, Homo sapiens
  misc_feature: GYAE6OF01EWHN0.51.32.C10.1.454.CMB.1.raw
  modified_base (277)..(277): a, c, t, g, unknown or other
  misc_feature (277)..(277): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacncccctaactcctgactctatgctgcagcctattgactaaagtgacgtcccatcgaggttcagtggcaggtcggtctgggacagtactttctctctcactattagctagtctgactaacctgtaacgtattttgactaacttactactgtacaagtagtagttacaattcgacctatctacttaccggaccgtaagggacacggactaggaagaacttaaacgacttggtacggctgacc

SEQ ID NO: 71119 - DNA, 503 bp, Homo sapiens
  misc_feature: GYAE6OF01CGD2X.51.32.C10.1.454.CMB.1.raw
  modified_base (277)..(277): a, c, t, g, unknown or other
  misc_feature (277)..(277): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacncccctaactcctgatctatgctgcagccactttgacaaagtggatcccatcgaggttcagtggcagtggtctgggacagtatttctctctcaccattagcagtctgctaacctgagtattttgactaacttactactgtacaactagtaattacaatttgaccctatcctactttcggaccgtaacgggacacgactggaataacgttaaacgactgaggctgacc

SEQ ID NO: 71120 - DNA, 532 bp, Homo sapiens
  misc_feature: GYAE6OF01D4G2M.51.32.C10.1.454.CMB.1.raw
  modified_base (223)..(223): a, c, t, g, unknown or other
  misc_feature (223)..(223): n is a, c, g, or t
  modified_base (380)..(380): a, c, t, g, unknown or other
  misc_feature (380)..(380): n is a, c, g, or t
  modified_base (392)..(392): a, c, t, g, unknown or other
  misc_feature (392)..(392): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccggnaagacagacatggcagctatttaaatgtatcagcaagaaaccagggaacgcccctaaactcctagactctatgctgcagtccactttgacaaagtggatcccatcgagttcagtgcaggtggtctgggacagtatttctctctcacattagcagtcngcaactgaagtntttagactaacttactacttgtacaacgtaagtaactttaacgaacttttcgaccctattacctaccgtttacggaccgtaaacgggacacggtactacgggaagttaaacgttaaacgaactaggttcggctacggacc

SEQ ID NO: 71121 - DNA, 520 bp, Homo sapiens
  misc_feature: GYAE6OF01BLXNF.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacgcccctaacctcctgatctatgctgcagcctactttgcaaagtggagtcccatcgagttcagtgcagtggtctgggactagtatttctctctcacctattagcagtctgacaacctgaagtattttgactaacttactactgtacaactagtagttactaattcgaccctatctacgtttccggaccgtaagggacacggtacgtaggaagtaacgttaaacgacgttaggtcggctgtaccc

SEQ ID NO: 71122 - DNA, 551 bp, Homo sapiens
  misc_feature: GYAE6OF01BRWW8.51.32.C10.1.454.CMB.1.raw
  modified_base (224)..(224): a, c, t, g, unknown or other
  misc_feature (224)..(224): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggnaagacagaacattggcagctatttaaattggtatcagcagaaaccagggaaacgcccctaacctcctgatctatgctgcagcctactttgactaaagtggacgtcccagtcgtaggttcaggtcggacaggttcgggtcgtgggactagtatttctcctctctacctattacgctagtctacgacctaaccgtgaagttattttacgactaactttactactgtacaacgtagtacgttactaactttcgaccctatcctacgttaccggaccgtaagggaccacggtacgtaggaagtaattaaacggactggtcgtcgtcgtacc

SEQ ID NO: 71123 - DNA, 542 bp, Homo sapiens
  misc_feature: GYAE6OF01DJDNA.51.32.C10.1.454.CMB.1.raw
  modified_base (277)..(277): a, c, t, g, unknown or other
  misc_feature (277)..(277): n is a, c, g, or t
  modified_base (356)..(356): a, c, t, g, unknown or other
  misc_feature (356)..(356): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacnccctaacctcctgatctatgctgcagcctattgacaaagtggactcccatcgagttcaggtgcaggtcggtctgggacngtatttctctctcactattacgctagtctgctaacctgaagtatttgactaacttactactagtacaactagtacgttaactaactttcgacctacttacctaccgtttacggaccgtaaacgggacaacggtaacgtacgggtaagtaaacgttaaacggaacttaggtacggtctcgtaacccg

SEQ ID NO: 71124 - DNA, 523 bp, Homo sapiens
  misc_feature: GYAE6OF01BTNC6.51.32.C10.1.454.CMB.1.raw
  modified_base (277)..(277): a, c, t, g, unknown or other
  misc_feature (277)..(277): n is a, c, g, or t
  modified_base (338)..(338): a, c, t, g, unknown or other
  misc_feature (338)..(338): n is a, c, g, or t
  modified_base (407)..(407): a, c, t, g, unknown or other
  misc_feature (407)..(407): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggatcagcaagaaaccagggaaacncccctaactcctgatctatgctgcagcctactttgactaaagtggactcccatcgaggttnagtggcaggtcggtctgggactagtactttcgtctcctctaccattagctagtctgactaactgaaatntttcgactaacttactctagtacaactaggtattaactatttcgacctatccgtacgtttccggacaacgggtcaacggtactaggaataaacgttaaacgacttggtgctcgtac

SEQ ID NO: 71125 - DNA, 591 bp, Homo sapiens
  misc_feature: GYAE6OF01CY4HQ.51.32.C10.1.454.CMB.1.raw
  modified_base (223)..(223): a, c, t, g, unknown or other
  misc_feature (223)..(223): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcacatcacttgccgggnaagacagaacatggcagctaattaattggtatcagcaagaaaccgaggaaacgccctaacctcctagactctatgctgcagcctacttgactaaagtggacgtccagtcgtaggttcgaggttggacgtaggttcgggtcgtaggggactaggtactttcgtctcctacactagttacgctacgtctacgacctaacgtagtaagtatttagtactaacttactactacgtactaacgtagtaacgttactaacgttacgacctataccgtaccgtttaccggaaccgtaaacgggtaaccgaacggtacgtaacgggtaacgtaaacgttaaaaccggtaacgttacggtacggtcgtcggtaaccc

SEQ ID NO: 71126 - DNA, 548 bp, Homo sapiens
  misc_feature: GYAE6OF01CP2WL.51.32.C10.1.454.CMB.1.raw
  modified_base (403)..(403): a, c, t, g, unknown or other
  misc_feature (403)..(403): n is a, c, g, or t
  modified_base (542)..(542): a, c, t, g, unknown or other
  misc_feature (542)..(542): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccggaggtgccagatgtgacatccagatgacccagtctccatcttccctgtctgcatctgtaggagacagagtcacatcacttggccggacaagacagaactagttggcagataatttaaattggtatcagacaagaaaaccgagggaaactcccctaaacctcctagtatctaatcgctgcagcctacgttgacaaagtggactccagtcgagttcagtggcaggtggtcgtaggacagtattctctctacactattagactaggtcncgtaactaactagaagttatttacgactaaacctttactacgtagttacaagtaagtaagttactaattccgacctagttccacgtttacggacaacgggacacggagtaggtaagtaacttaaaacgacttaggacgntgaacc

SEQ ID NO: 71127 - DNA, 575 bp, Homo sapiens
  misc_feature: GYAE6OF01CJR1D.51.32.C10.1.454.CMB.1.raw
  modified_base (393)..(393): a, c, t, g, unknown or other
  misc_feature (393)..(393): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacgcccctaacctcctgatctatgctgcagcctactttgactaaagtggactcccagtcgaggttcaggtggctaggtgggtctgggactagtatttctctctacacattagcagttcngacaacctgaagttatttcgactaacgttactaacgtgtacaaacgtagtagtttaactaacttttacgaccctaattacctaccgttttaccgggacccgtaaaggggaaccctaacggtaacgttacgggaaagtaacgtttaaaaacggacgttagggtacggtaccgttacgaacccg

SEQ ID NO: 71128 - DNA, 549 bp, Homo sapiens
  misc_feature: GYAE6OF01CKYH4.51.32.C10.1.454.CMB.1.raw
  modified_base (281)..(281): a, c, t, g, unknown or other
  misc_feature (281)..(281): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagcttaatttaaattggtatcagcaagaaaccagggaaacncccctaacctcctgatctatgctgcagcctacttgactaaagtggactcccatcgagttcagtggcaggtggtctgggacagtatttctctctcactattagctagtctagacctaaccgtgtaacgttattttcgaacttaactttactacttacgtacaacgtagtaagttaactaatttcgaccctattctaccgtttacggaccgtaaacgggtacaacggtacgtaggaagtaacgttaaacgacgtaggtcggctggtaccc

SEQ ID NO: 71129 - DNA, 664 bp, Homo sapiens
  misc_feature: GYAE6OF01CKNII.51.32.C10.1.454.CMB.1.raw
  modified_base (290)..(290): a, c, t, g, unknown or other
  misc_feature (290)..(290): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctccatccttccctgtctgcatctgtaggagacagagtcaccatcacgttgccgggacaagacagaacagttggcagtacttaatttaaattggtatcagacaagaaaccgagggaaacncccctaacctcctagactctatcgctcgacacgtcctaacttgacgtaaagtcggactcccagtcgtagttcgaggtggactagggttggtcgtagggactaggtacttttccgtctaccttaccgaaccttagttacgcgtaacgttcgtacgtaaccgtaaccgttaggtaaacgtttacttttacggaacctttaaaacctttaccttaaccttacggttaacctaaaccgtaaggttaacgtttaaccttaacgttttccgaaccccttaagttaccctaccggtttaccggaacccggtaaacgggacctaacggtacgttagggaaacgtaaacgttaaaccggaacttgggtacgtcgtacgtaccc

SEQ ID NO: 71130 - DNA, 613 bp, Homo sapiens
  misc_feature: GYAE6OF01BM12E.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctcatccttcctgtctgcatctgtaggagacagagtcaccatcactgccggcaagacagaacattggcagcttaatttaaatggtatcagcaagaaaccgagggaaacgcccctaactcctgatctatgctgacagcctactttgacgtaaagtggacgtccctagtacggtaggttcgaggtcggacgtagggttgggtaccgtagggactagttactttcgtacttctaccaaccttagtacgctacgtctacgacctaaccgtagtaaggttatttacgaaccttaactttactacgttacgtaacaaacgtagttaacgttaacttaatttccgaccctattaccgttaccgtttaccgggaaccgtaacgggtactaaccggtacggtacggtaaacgtaaacgttaaaccgtagttaggtacggtacgtcggaaccc

SEQ ID NO: 71131 - DNA, 531 bp, Homo sapiens
  misc_feature: GYAE6OF01EWFBW.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacgcccctaactcctgatctatgctgcagcctactttgacaaagtggactcccagtcgaggttcaggtggcgagtgggtctgggacagtatttctctctcacctattacgctagtctgccaacctgtaagtattttgactaacttactactgtacaactagtacttactaatttcgaccctatcctaccgtttcggaccgtaaagggaccacggtacgtagggaataaacgttaaacggaacttggtcggctggacc

SEQ ID NO: 71132 - DNA, 594 bp, Homo sapiens
  misc_feature: GYAE6OF01C2MA8.51.32.C10.1.454.CMB.1.raw
tcagcgatcgtatacacgaccggtgctcgatttagtatagacatcaacacacaaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacatggcagctatttaaattggtatcagcaagaaaccgaagggaaacgcccctaacctcctgatctatgctgcacgcctactttgactaaaggtcggacgtccccagtcggtaggttcgaggtggcgtaggtgggtctgggactagtactttctctcctacaccctaattagactagtctcgacctaaccgtagaagttattttacgactaaacctttactactacgtacaacgtagtaattactaactttcgaccctattcctaccgtttcggaccgtaaacggaccgtaaccggtaacgtacgggtaaagtaaacgtttaaaaccggtaacggttacggtacggtccgttagaaccccg

SEQ ID NO: 71133 - DNA, 523 bp, Homo sapiens
  misc_feature: GYAE6OF01BTRGO.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacgcccctaacctcctgatctatgctgcagccatttgcaaagtggatcccatcgaggttcagtggcaggtggtctgggacagtatttctctctcacctattagcagtctgcaacctgaagtattttgctaacttactactgtaccaacgtagtagttaacaatttgaccctatcctaccgtttaccggaccgtaacgggacacggaacgtggaagaacgttaaaacgaacttggtaggcctggtaccc

SEQ ID NO: 71134 - DNA, 583 bp, Homo sapiens
  misc_feature: GYAE6OF01B8F9V.51.32.C10.1.454.CMB.1.raw
  modified_base (226)..(226): a, c, t, g, unknown or other
  misc_feature (226)..(226): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttggccggganaagacagaacattggcagcttaatttaaattggtatcgagacaagaaaccgagggaacacccctaactcctagatctatcgctgacacgcctatttcgactaaaggtcggaacgtcccgaatcgtaggttcaggtggacgtagggtggtcgtagggactagtactttcctactctcgtaactagttacgactacgtactacgacctaaccgtagtaagttactttacgaccttaacttactactagtaccaatagtacttactaacttcgaaccctagtacctaccgtttacggaccgtaagggacctaacggtacgtaggaaataacgttaaacgacgtaggtacgcgtcgtaacc

SEQ ID NO: 71135 - DNA, 578 bp, Homo sapiens
  misc_feature: GYAE6OF01DE4SY.51.32.C10.1.454.CMB.1.raw
  modified_base (277)..(277): a, c, t, g, unknown or other
  misc_feature (277)..(277): n is a, c, g, or t
  modified_base (384)..(384): a, c, t, g, unknown or other
  misc_feature (384)..(384): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagcagaacattggcagctaatttaatggtatcagcaagaaaccagggaaacncccctaactcctagactctatgctgcacgcctactttgactaaagtggactcccagttcggaaggttcaaggttggacgtaggtgggtctaggggactagtatttcncttctcacctattagctagtctacgctaacctgtaacgtatttacgactaactttactaacgttcgtactaacgtagtaacgtttactaactttcgaccctatcctaccgtttaccggacgtaaacggggaccaacggtacgtacgggtaagtaaacgttaaaacggtaacttaggtacgggccttggaacccc

SEQ ID NO: 71136 - DNA, 533 bp, Homo sapiens
  misc_feature: GYAE6OF01A5LHM.51.32.C10.1.454.CMB.1.raw
  modified_base (402)..(402): a, c, t, g, unknown or other
  misc_feature (402)..(402): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacgcccctaacctcctgatctatgctgcagcctactttgcaaagtggacgtcccatcgaggttcagtggcagtggtctgggacagtatttctctctcacctattagctagtctgacaacctgaagtnttttgactaactttactactagtaccaactagtaagtttacaatttcgccctatctacgtttccggaccgtaaagggccaacggtactagggaacgtaactttaaacggaacttaggtcggtctggtaccc

SEQ ID NO: 71137 - DNA, 553 bp, Homo sapiens
  misc_feature: GYAE6OF01BV02H.51.32.C10.1.454.CMB.1.raw
  modified_base (275)..(275): a, c, t, g, unknown or other
  misc_feature (275)..(275): n is a, c, g, or t
  modified_base (351)..(351): a, c, t, g, unknown or other
  misc_feature (351)..(351): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaatggtatcagcagaaaccagggaacncccctaactcctgatctatgctgcagcctattcgactaaagtcggactcccagtcgaggttcaggtgcagtggtcngggacagtatttctctctcactattacgctagtctcgctaaccgtgtaacgtattttacgactaacgtttactacgttacgtacctaacgtacgtaacgttactaactttcgaccctatccgtaccgtttaccggaccgtaacgggtaccacggaccgttagggaactaacgttaaaccgactcggtacggtcgtcggtacc

SEQ ID NO: 71138 - DNA, 537 bp, Homo sapiens
  misc_feature: GYAE6OF01CH5E4.51.32.C10.1.454.CMB.1.raw
  modified_base (281)..(281): a, c, t, g, unknown or other
  misc_feature (281)..(281): n is a, c, g, or t
  modified_base (384)..(384): a, c, t, g, unknown or other
  misc_feature (384)..(384): n is a, c, g, or t
  modified_base (419)..(419): a, c, t, g, unknown or other
  misc_feature (419)..(419): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagcttaatttaaattggtatcagcaagaaaccagggaaacnccccctaacctcctgatctatgctgcagcctactttgacgtaaagtggacgtcccatcgtaggttcaggtggcgtaggtcgggtctgggactagtacttttcnctctcacctattacgcagtctgctaacctgaagtnttttcgactaacttactactcgtacaacgtagtagttactaatttcgaccctatctacgtttccggaccgtaagggacacggtatggaataacgttaaacgactggtcggctgtaccc

SEQ ID NO: 71139 - DNA, 805 bp, Homo sapiens
  misc_feature: GYAE6OF01CFP61.51.32.C10.1.454.CMB.1.raw
tcagcgatcgtatacacgaccggtgctcgatttagtatagacatcaacacacaaagggggagtcagtctcagtcaggacacagcatggacatgacgggtccccgctcagctcctggggctcctgctactctggctccgaggtgccagatgtgacatccagactcgacccagtctccatccttcctgtctgctattctgtaggagactagacgtacacctatccacgttcggcccgggacaaaggaccaaggtaacctagtttcggactaggtaacttaaagttttaaaacgttcggtaactacgaaggactaaacgggaaaacccgaagggggtaaaaccctaccccccttaaactccttaagtaacttaccttaagtcggacccttaggacctaaccggtaccttaacgttttcgaaccgtaaaaggttcggtaaccgtaccccgtagtaccggtaacgggtttccgaaggttcggaccgtagggttccggggtacgtacggggaacttacgtacgttttaccgtaccgtacccttaaccgtaaccgttaacgttacggtccgtaaacgttccgttaacggaaccgttaacccgttaggtaaacttttacgtttacgtaaccttaaaccgtttactccgtaacgttacccgaaaacccttagggttaacctttaaccttaaccggtttccgaccctaacgttcccgtaaaccgtttacccgggaaccgttaaacgggaccctacgtaacggtaacggtaacgtaaaccgttaaacggacgttacggtagtcccgtggtaacccc

SEQ ID NO: 71140 - DNA, 573 bp, Homo sapiens
  misc_feature: GYAE6OF01C0UN9.51.32.C10.1.454.CMB.1.raw
  modified_base (279)..(279): a, c, t, g, unknown or other
  misc_feature (279)..(279): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggacaagacagaacattggcagcttatttaaattgtatcagcagaaacgagggaaacncccctaacctcctgactctatgctgcagccacttgacaaggtggacgtccagtcgaggttcaggtgcgaggtggtcgtgggactagtactttccgtctacgttacctaacctattacgactacgtcgtacgacaaacccgtagtaagttactttttacgacctaaactttacgttaacttcgtaacctaacgtagtaacttaacgtaatttcgaccctattcctaccgtttcggaccggtaaggacctaacggacgtaggaataacgttaaacgaactggtaggcgtgtaaccg

SEQ ID NO: 71141 - DNA, 684 bp, Homo sapiens
  misc_feature: GYAE6OF01BKKUH.51.32.C10.1.454.CMB.1.raw
  modified_base (316)..(316): a, c, t, g, unknown or other
  misc_feature (316)..(316): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagcttaatttaaattggtatcagacaagaaaccgaaggaaacgacccctaacctcctagactactatcgctgcacncctactttacgacgtaaggtcggacgtcccagtacgtacggttacgaggtcggacgtaggtggtcgtagggactagtactttcctacgttctacctactacgttacgactacgttcctacgtaacctaacccgttagtaaacgttacgttttacgtaaccgtttaaacctttaacgtaaccgtttacgttaacgtaaacgtaacgttaacgtttaaacgtaacgtttaccggtaacccttaacgtttacccgtaaccggtttacccggtaaccggtaaaccgggtaacccgtaacggttaccggttaaggtaaacggttaaaccgtttaaaaccggtaacgttaggtaccgtacggtaccgtaacccg

SEQ ID NO: 71142 - DNA, 619 bp, Homo sapiens
  misc_feature: GYAE6OF01CVF5C.51.32.C10.1.454.CMB.1.raw
  modified_base (299)..(299): a, c, t, g, unknown or other
  misc_feature (299)..(299): n is a, c, g, or t
  modified_base (610)..(610): a, c, t, g, unknown or other
  misc_feature (610)..(610): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtcctccatcttccctgtctgcatctaggtaggagacgagacgtcaccatcacgttcgaccgggacaagacaagaactagttggacagtacttaatttaagtggtatcagacaagaaaccgaaggaaaccncccctaacctctagtactactatcgctacgacacgtacctacgttacgaacgtaaggtcgaccgtaccctagtaccggtaaggttcgaaggtcggacgtagggtcggtcgtagggactaggttctttccgtacttcctactacctagtttacgactacgttcgtaccgactaacgtagtaacttatttacgaacttaacttactacgtacgtactaagtacgtaacttacttaacttcgacccttattcccgtacgttaccggacgtaacggtacacgtacgaggtaaattaacgtaacggtatggtacgngtcgtaacc

SEQ ID NO: 71143 - DNA, 540 bp, Homo sapiens
  misc_feature: GYAE6OF01D2UHP.51.32.C10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatgacccagtctccatcttccctgtctgcatctgtagganacagagtcaccatcacttgccgggacaagacagaacattggcagctaatttaaatggtatcagcagaaaccagggaaacgcccctaactcctgatctatgctgcagccactttgacaaagtggacgtcccatcgagttcagtggcaggtggtctgggatagtatttctctctcacctatagctagtctgacctaaccgtgtaagtattttacgacttaaactttactaactacgtacaaactagtacgttaactaatttcgaccctattcctacctttccggaccgaaacgggacaacgacgtaggagtaaactaaacggaactaggtggcgtcgtaccg

SEQ ID NO: 71144 - DNA, 624 bp, Homo sapiens
  misc_feature: GYAE6OF01BWF2R.51.32.C10.1.454.CMB.1.raw
  modified_base (286)..(286): a, c, t, g, unknown or other
  misc_feature (286)..(286): n is a, c, g, or t
tcagcgatcgtatacacgaccggtgctcgatttagtatagacatcaacacacaaaggggggagtcagtctcagtcaggacacagcatggacatgagggtcccgctcagctcctggggctcctgctactctggctccggaggtgccagatgtgacatccagatgacccagtctccatccttccctgtctgcatctgtaggagacagagtcaccatcacttggccgggacaagacagaacattggcagtcttaatttaatggtatcagacaagaaaccgagggaaacncccctaacctcctgactctatgctgcagcctagtttgacaaggtcggacgtcccagtcggagttcaggtggacgtaggttgggtcgtagggactagtacgtttcctactcgtacacctattacgctacgttctacgtacctaacgttagtaaacgttattttacgaaccttaaacctttactaccgttagtaaccgtaaacgtacgttaactttaactaactttacgaccctaagttacctaccggtttaccggaccggtaaacgggtaccaacggtacgtaacgggtaaacttaaacgttaaaaccggtacgtagggttacggtcgtacggtaaccc

SEQ ID NO: 71145 - DNA, 595 bp, Homo sapiens
  misc_feature: GYAE6OF01B52Q2.51.32.C10.1.454.CMB.1.raw
  modified_base (343)..(343): a, c, t, g, unknown or other
  misc_feature (343)..(343): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggacaagacagaacagttggcagctaatttaatgtatcagacaagaaacaggaaacgtcccctaacctctgatctatgctgcacgacctacttagacaaaggtgacgtccagtcgagtcagngcgtaggtggtctgggtacagttatttcctactctactacctaattacgctaggtctacgacctaaaccgttaggtaattacgttttacgacttaaacctttacgaactttacggttacaaacgtagttaaacgttactaatttccgaaccccttagtaccgtttacccgttacgggacccgtaaagggacctaaacggtcgtaaacggaaggttaaactaaaccggttactacgggtagtcgtacgaaccc

SEQ ID NO: 71146 - DNA, 577 bp, Homo sapiens
  misc_feature: GYAE6OF01CVXWR.51.32.C10.1.454.CMB.1.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
tcagcgatcgtatacacgaccggtgctcgatttagtatagacatcaacacacaaagggggagtcagtctcagtcaggacacagcatggacatgagggtcccgctcagctcctggggctcctgctactctggctccgaggtgccagatgtgacatccagatgacccagtcctccattcttccctgtctgcatctgtaggagacagagtcaccatcacttgccgggnaagacagaacattggcagctatttaaatggtatcagcagaaacagggaaacnccctaacctctgatctatgctgctagcctacttgactaagtggacgtcccagtcgaggttcaggtggcaggtggtctgggactgtattctctctcactattagctagtctagacctaaccgttagaacgttattttacgacctaaactttactaacttacgtactaaactagtaacgttaactaactttcacccgtaattccgtaaccgtttcgggacccgtaaagggacctaacggtaaccgttaagggaaacgttaaacgttaaacccggtaaacttggtacggtccgttggaacccc

SEQ ID NO: 71147 - DNA, 580 bp, Homo sapiens
  misc_feature: GYAE6OF01E0GRQ.51.32.C10.1.454.CMB.1.raw
  modified_base (427)..(427): a, c, t, g, unknown or other
  misc_feature (427)..(427): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctaatttaaattggtatcagcaagaaaccgagggaaacgcccctaacctcctagactctatgctgcacgcctactttagactaaaggtggacgtcccagtcggtaggttcaggtggacgtaggtgggtcgtgggacagtattctctctcactattacgctagtctcgacctaaccgtgtaacgtnttttcgacctaactttactactacgtacaaacgtagtagtttaactaatttccgaccctattccgttaccgttaccggaccgtaaacgggtaccaacggtacgtagggtaacgtaaacgttaaaccggacttagggtacggtcgtcggaaccc

SEQ ID NO: 71148 - DNA, 679 bp, Homo sapiens
  misc_feature: GYAE6OF01CEHV9.51.32.C10.1.454.CMB.1.raw
  modified_base (225)..(225): a, c, t, g, unknown or other
  misc_feature (225)..(225): n is a, c, g, or t
  modified_base (290)..(290): a, c, t, g, unknown or other
  misc_feature (290)..(290): n is a, c, g, or t
  modified_base (439)..(439): a, c, t, g, unknown or other
  misc_feature (439)..(439): n is a, c, g, or t
  modified_base (508)..(508): a, c, t, g, unknown or other
  misc_feature (508)..(508): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatctccctgtctgcatctggtaggagacaggatcactatcacttggccgganaaagacaagaacagttggacagtacttaatttaaagtggtatcagacaagaaaccgagggaaacncccctaactctagactcgtatcgctcgctaacgtcctagtttacggaacctaaagggttcggaccttaccccgtagtaccgggtacgtttacggaaggtcgggtacctagggttcggggtactacgggggaacttaggttaccttttcnccgttacctccgtaaacctagttacggaccgtaaggttcctacggtaaccctaacgtaggtaacgtttntttacgacttaaacttactacgttacgaacctaaacgtagttaaacgtttactaaacgtttccgaaccttagttacccgaccgtttacggaacccgtaacggtaacaccggtacgtaagggaaaccgttaaagtaaaccggtacggttacgacggttccgtaacgtacccg

SEQ ID NO: 71149 - DNA, 588 bp, Homo sapiens
  misc_feature: GYAE6OF01BF6Y4.51.32.C10.1.454.CMB.1.raw
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatgacccagtctccatccttccctgtctgcatctgtaggagacagagtcaccatcacttggccgggcaagacagaacattggcagtcttaatttaaattggtatcagcaagaaaccgagggaacgcccctaactcctgatctatgctgcacgcctactttgacaaaggtcgacgtcccaagtcgtaggttcaggtggcaggttgggtcgtaggggactaggtatttcctcttcctaccaccttattacgactagttcctcgacctaaaccgttgaacgtttatttacgaccttaactttactactagtaacaacgtagtactttaactaagtttccgaccctataccttaccgttccggaaccgtaacgggacaacggtacgtaggaaacgtaacgttaaaaccgagttcggtacggtcgtggaaccc

SEQ ID NO: 71150 - DNA, 609 bp, Homo sapiens
  misc_feature: GYAE6OF01AJ3G6.51.32.C10.1.454.CMB.1.raw
  modified_base (281)..(281): a, c, t, g, unknown or other
  misc_feature (281)..(281): n is a, c, g, or t
  modified_base (384)..(384): a, c, t, g, unknown or other
  misc_feature (384)..(384): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttggccgggcaagacagaacattggcagcttaatttaaattgtatcagcaagaaaccgagggaacncccctaacctcctgatctatgctgcagtcctactttgacaaagtcggactcccagtcggtagttcaggtcggcgtaggttgggtctgggactagttactttcnctcctctaacctagttacgctacgtcctcggaacctaaccgtaggtaacgttacttttacggaccttaaacgtttaacctacttagtaccaaacgtagttaacgttaactaacgtttcgaccctaagttcccttaaccgtttccggaaccgtaacggggtaccaaccggtactaaggggtaaattaacgttaaaaccggtaactgggttacggacgttcgacccg

SEQ ID NO: 71151 - DNA, 620 bp, Homo sapiens
  misc_feature: GYAE6OF01BGV11.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtaggagacagagtcaccatcacgttgccggcaagacagaacatggactagacttaatttaaattggtatacagacaagaaaccgaagggaaacctccccctaactcctcgacttactatcgctcgacacgtacctacgttgaacgtaaggtcggaacgtaccctacgttacggtacggttacctaggtcggacgtacgggttggggtcgtagggactagtttactttccgtactccgtacctaactagttacgctaacgtcacgtacctaaccgtaggtaatttgttacgtaaccttaacgtttaccgtacttacgtaacaagtaacgttatttaactacttcgacctatccttacggttaccggacgtaagggtaccacggtacgtagtaacgtaaagttaacgacgttaggacgtctcgtaacc

SEQ ID NO: 71152 - DNA, 714 bp, Homo sapiens
  misc_feature: GYAE6OF01DKAPZ.51.32.C10.1.454.CMB.1.raw
  modified_base (350)..(350): a, c, t, g, unknown or other
  misc_feature (350)..(350): n is a, c, g, or t
  modified_base (498)..(498): a, c, t, g, unknown or other
  misc_feature (498)..(498): n is a, c, g, or t
tcagcgatcgtatacacgaccggtgctcgatttagtatagacatcaacacacaaagggggagtcagtctcagtcaggacacagcatggacatggagggtccccgctcagctcctggggctcctgctactctggctccgaggtgccagatgtgacatccagatcgacccagtctccacttccttccctgtctcgctatcgtagtaggagacagagtccaccatcacgttcggaccgggacaagactaagaactagttggactagtacttaaattttaagtgtatacgaagacaaggaaaaccgaacgggaaacctaccccttaactcctagtacttacgtaagtcgtcgtnacgtaccgtaccgtaacgtttcgaaacgtaacgggttacggaccttaccgaggttaccgggtaaggtttcgaggtcgggtacgtaggggttcggttaggtacggacgtttaacgtacttttccaccgtacctacgtacgttagttacncgttacgttactaccgaactaaccgttaaggttaatttacgtttacgaactttaacgtaccttagtaacgtaccaaagtaccggttaacttacgttacttccgaacctacgttaccgttaaccggttacggaaccggtaaccggaacccttaagggtacgtaagggttaaacgtaaccgttaaaacggcgtttacggcggtacccgttcgaaaccg

SEQ ID NO: 71153 - DNA, 490 bp, Homo sapiens
  misc_feature: GYAE6OF01ANCYE.51.32.C10.1.454.CMB.1.raw
tcagcgatcgtatacacgaccggtgctcgatttagtatagacatcaacacacaaagggggagtcagtctcagtcaggacacaacatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaagcccctaacctcctgatctatgctgcagccactttgcaaagtgagtcccatcgaggttcagtggcagtgggtctgggacagatttctctctcaccattagcagtctgcaacctgaagtattttgctaacttactactgtacaacagagttacaatttgcccatcactttcggcctaagggacacgactggagtattaaacgactgtagctgcacc

SEQ ID NO: 71154 - DNA, 606 bp, Homo sapiens
  misc_feature: GYAE6OF01D5KDW.51.32.C10.1.454.CMB.1.raw
  modified_base (201)..(201): a, c, t, g, unknown or other
  misc_feature (201)..(201): n is a, c, g, or t
tcagcgatcgtatacacgaccggtgctcgatttagtatagacatcaacacacaaaggggggagtcagtctcagtcaggacacagcatggacatgagggtccctgctcagctcctggggctcctgctgctctggctctcaggtgccagatgtgacatccagatgacccagtcctccatcctccctgtctgcatctgtagganacagagtcaccatcacttgccaggcgagtgaggacattaagtaacttatttaaattggtatcagacagaaaccgaggacaacgacccctaaactcctagactctacgatgacatacctaagtttaggaaacgtacggggtacccagtacgtaaggttacaggtagggtaaggttggttacgtgggaactagttactttttaccgtttaccaacctatcagtaccacgtcccttaccaccctagaacgtattcttagacaactattacttacgtcgtacaacgtagtatagtaattaactcctaccctacttcctaccggtttacgggacgggtaacgggtaacccgtaaggggtagaacgtaactaaccgtaaaccggaacgttaggtacggtcgtcggtacccg

SEQ ID NO: 71155 - DNA, 801 bp, Homo sapiens
  misc_feature: GYAE6OF01C38EF.51.32.C10.1.454.CMB.1.raw
tcagcgatcgtatacacgaccggtgctcgatttagtatagacatcaacacacaaagggggagtcagtctcagtcaggacacagcatggacatgacgggtccccgctcagctccgtggggctcctgctactctggctccgaggtgccagatgtgacatccagatcgacccagtctccattccttccctgtctgcatcgtaggtagagacagacgtcacatcacgtcggccggacaagacaagaactagttcggactaagtactttaaagttttaaacgtggtaatcgaagaccgaaacggaaaaccggaacgggaaacctaccccccttaaaccgtccgtagtaacttaccgttagtcggtactacggactaccgtacccgttacgtttacggaaaccgtaaagggttccggtaaccgtaccccggtaaggtttaccgggtaacgggttacgtaagggttccgggtacggttaaggggttcggggttaccgtaaggggtaacctagggtttacctttcccgtccttacccgtacgtaaccgttaacgtttacgtaccgtaacgttccggaaccgtaacccttaacggtacgttaacgtttacgtttttaacgaacctttaaccgtttaaccgtacgttaaccgtaacctaaacgtttacggtaaacttaactttacgttacccgtaccctagttacccttaccgggtttaaccggaaccgtaaacgggaacccttacggtacggttaaaccggtaagttaaaccgtaaaccgtaggtttacggaccggttcctggtaaaccc

SEQ ID NO: 71156 - DNA, 671 bp, Homo sapiens
  misc_feature: GYAE6OF01B4NK0.51.32.C10.1.454.CMB.1.raw
  modified_base (299)..(299): a, c, t, g, unknown or other
  misc_feature (299)..(299): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcctccatccttccctgtctgcatctgtaggagacagagtcaccatcacgttgccgggacaagacagaacattggcagtacttaattttaaagttggtactcgagacgaacgaaaacccgaggggaaaccncccccttaaccgtcctacgatctatcgcttcgacacgtaccctagtttacgacgtaaaggtcggaacgtcccaagttcgggacggtttcaggtggacgtaggttcgggtcgtaggggactaggttactttctcctacgtacaacctagttacgctaacgtcctacgacctaaccgtagtaacgtacgttttcgaaccttaactttaacgtaccttacggtaacctaaacgtaacgttacgtttaacttaagtttcccgaaccttacgttaccgttaccgtttacccgggaaccgtaacggggtaaccctacggtaacgttaggtaaacggtaaacgtttaaaccggaccggttgtaccggtcgtggtacccc

SEQ ID NO: 71157 - DNA, 717 bp, Homo sapiens
  misc_feature: GYAE6OF01CWSSJ.51.32.C10.1.454.CMB.1.raw
  modified_base (230)..(230): a, c, t, g, unknown or other
  misc_feature (230)..(230): n is a, c, g, or t
  modified_base (271)..(271): a, c, t, g, unknown or other
  misc_feature (271)..(271): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctccattccttccctgtctgcatctggtaggagacagagtcaccatcacttggccggganaagtacagaacattggacagtacttaatttaatggtactanagacaacgaaaccgagggtaaaccaccccgtaacctccgtagaacttcgtaactcggtactacgaccgacgtaccccttagtttacgaaccgtaaaggtcggtaacgtccccgtaagtaccggtacggttacaaggtcgggaccgtagggttccgggttagtacgggaacctaggttaacttttcctccgttacctacctaaaccgttaacgtttacggaccgttaacgttccgtacgtaaccctaaccggttagtaaccggtttattttacggacccttaaacttacgttaacgtacgtaacgaaacgtagttaacgttacttaacgttccaccctagttacccttagttaccgggaaccgtaaacggggtactaaccgggtaacgtaacgggtaaagttaaaccgttaaacgtaacggttggtaacggtcccgtgtaaaccccg

SEQ ID NO: 71158 - DNA, 590 bp, Homo sapiens
  misc_feature: GYAE6OF01AO3N0.51.32.C10.1.454.CMB.1.raw
  modified_base (224)..(224): a, c, t, g, unknown or other
  misc_feature (224)..(224): n is a, c, g, or t
  modified_base (285)..(285): a, c, t, g, unknown or other
  misc_feature (285)..(285): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggnaagacagaacattggcagcttaatttaaattggtgtcagacaagaaaaccgagggaaaccncccctaacctcctgatctatgctgcacgcctatttgactaaaggtggaactccctagtcggtacggttcaggttggctaggttgggtcgtggggactaggtacttttcctcgtcctacacctattacgctagttcgtacgtacctaacgtagtaagttattttcgaacttaacctttactacgttagtaccaaatagtaacgtttaactaagtttccgaccctagttcctacgtttaccggaccgtaagggacctaacggacgtaggaacgtaacttaaaacggacgttaggtcgtcgtcgtacc

SEQ ID NO: 71159 - DNA, 600 bp, Homo sapiens
  misc_feature: GYAE6OF01CC4EM.51.32.C10.1.454.CMB.1.raw
tcagcgatcgtatacacgaccggtgctcgatttagtatagacatcaacacacaaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtccaccatcacttggccgggacaagacaagaacagttggcagtactaatttaaattggtatcagacaagaaaccgagggaaacctcccctaacctccgtagactcctatcgctcgcacgcctacgtttagactaaaggtcggacgttacccagtcggtaggttcgaggtggacgtgggtcgggtctggggactagttactttcacttcctacaccgtattagctagtcctagacctaacttgtaagttcgttttacactttaaaccttctacgttacgtaccaagtacgttaacttactaacttcgaccctatccttacgttcccggacgaagggacctaacggcgtaaggtaacgtaaacttaaccggagttggtccggtactcggtaaaccc

SEQ ID NO: 71160 - DNA, 719 bp, Homo sapiens
  misc_feature: GYAE6OF01DVJME.51.32.C10.1.454.CMB.1.raw
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatgacccagtctccatccttccctgtctgcatctgtaggagacagacgtcaccactcacgttcggccgggacaagacagaacagttcggacagtacttaatttaagtggtatcagacaagaaaccgaacggaaccgtaccccttaacctcctagactctatcgctgaccacgtacctacgtttacgaacgtaaaggtcggaaccgtaccccgtaaggttccggtacgggtttaccgaagggttcgggtacgtaggggttcggggttcggtaacgggtaccgttaagtttaccgttttcccgtaccttacccgtaccgtaaccgtttacgtttacggcctttacgtaccgtaccgtaacctaaccgttaggtaaactttacgttttacgaactttaaccgtttaactacgttacgtaactaacttaaggttaacttaacttacgtttcccaaccttaccgttccgtaaccgttaccggaaccggtaacggtaaccgacggtaacgtaacgggtaaacgttaaacgttaaaccggacttagggtcgtaccgtcgtaacccg

SEQ ID NO: 71161 - DNA, 641 bp, Homo sapiens
  misc_feature: GYAE6OF01CN3Z9.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtcctccattccttccctgtctgcatctggtaggagacagatccaccatcctacgttcggccgggacaagacaagaactagttggacagtactttaatttaaattaggtatacagaccaaggaaacccgaaggggaaaacctcccccttaacctccgtagactactatcgtcgtcgacacgtacctacgtttagacaaaggtcggactacccagtcggtaggtttcgaggtcggacgtagggttcgggtacgtagggactagttacgtttcctacctccacctacctattacgctagtccgtcgaacctaaccgtagtaagttctttaacgacctttaaacttctacgtataacaacgtagtaacttaactagttaccacctacgttacccttacggttaccgaccgaaccggtactaaccggtagtacggtaacgtaaacgttaaacggacgttaggtaccgatcgtaaccc

SEQ ID NO: 71162 - DNA, 529 bp, Homo sapiens
  misc_feature: GYAE6OF01DETDN.51.32.C10.1.454.CMB.1.raw
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtaggagacagagtcaccatcacttcggccgggacaagcaagaactagttggcagtcttaatttaaatggtatcagcaagaaaccgaggaaccgcccctaactcctagactctatgctagcagcctagttgacaaggtcgactccagtcgagttcagtgcgtaggtggtcngggactgtactttcnctctcacattgctagtcngactaacgtgtaagtntttacgactaacttactactacgtacaacgtagtaattactaatttcacctactctacgttcgacgaacggtacacggtacgtaggaagtaacttaacgaatgtacggctgaaccc

SEQ ID NO: 71163 - DNA, 779 bp, Homo sapiens
  misc_feature: GYAE6OF01CEBMT.51.32.C10.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (320)..(320): a, c, t, g, unknown or other
  misc_feature (320)..(320): n is a, c, g, or t
  modified_base (769)..(769): a, c, t, g, unknown or other
  misc_feature (769)..(769): n is a, c, g, or t
tcagcgatcgtatacacgaccggtgctcgatttagtatagacatcaacacacaaagggggagtcagtctcagtcaggacacagcatggacatgacgggtccccgctcagctccgtgggggctcctgctactctggctccgaggtgccagatgtgacatcagatcgacccagtctccatcttccctgtctgcatctaggtagganacagacgtccaccatctacttcggacccggganaaggacaagaactagttggacagtactttaatttaaagttggtaatcgacgacaaacggaaaacccggaaacggggtaaaccncccccttaaaccctccgtacgtacttacctatcggcctgaccgtacgtcctaacgtttacggaaccgtaaagggtccggtaaaccgtcccctaagggttcccgggtaaggttacggtaacggttcggggtaccgtagggggtttccggggtacggttacggggaacgtttacgttaaccgttttccgttaccgttacccttaacctaccgttaaggtttaccgacgttaacccggttacgttaccggtaaacccgttaaacgttacggtaaggtttaaccttttaccggaactttaaacccgtttactaacggttactaacccggaaataccgggttaacttaacgtttaactccgtaaccctattaccgttaacccgttacggaacccggtaggaaccgtacggacggtaggtaaacgttaacgtaacggtacgtggtccggtaccgngttaaccccg

SEQ ID NO: 71164 - DNA, 614 bp, Homo sapiens
  misc_feature: GYAE6OF01DE2TD.51.32.C10.1.454.CMB.1.raw
  modified_base (230)..(230): a, c, t, g, unknown or other
  misc_feature (230)..(230): n is a, c, g, or t
  modified_base (288)..(288): a, c, t, g, unknown or other
  misc_feature (288)..(288): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
tcagcgatcgtatacacgaccggtgctcgatttagtatagacatcaacacacaaaagggggagtcagtctcagtcaggacacagcatggacatgagggtccccgctcagctcctggggctcctgctactctggctccgaggtgccagatgtgacatccagatcgacccagtctcctatccttccctgtctgcatctgtaggagacagacgtcaccatcacttggccgganaagcagaacatggcagtcttaatttaatggtatcgagctaagaaaccgagggaaaccncccctaactctgactctagtgctgacacgtcctacgttgactaaggtcgactcccagtcgtggttacgngtcggngtaggtggtctagggactgtactttcgctctacgactattagcgtagtctacgactaaccttagtaagttacgtttacgaccttaacctttacgtacgttacgtaactaacgtaagttacgttaaccttaacgtttccgaaccctacgttaccgtaccgtttaccggaaaccggtaacgggtaccaaacggttacggtaaacggtaacgttaaacgtaaaccggtaaggtgtaacgtcgtaccgtaacccg

SEQ ID NO: 71165 - DNA, 577 bp, Homo sapiens
  misc_feature: GYAE6OF01B0IWF.51.32.C10.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtagganacagagtcaccatcacttgccggnaagacagacattggcagctatttaaattggtatcagcaagaaaccgagggaaacncccctaacctcctgactctatcgctgacacgtcctactttgactaaaggtcggacgtcccagtccggtaggttcaggtgggctagggtcgggtcgtggggactaggttctttctctctacactattacgctaagtcctacgacctaaccgtgtaacgttattttcgaccttaactttactcgttagtaccaagtagtaactttactaatttccgaccctatccgttaccgttccggaccgtaagggacctacggtacgtaggaactaaagttaaaccgacgtaggtcggctcgaaccg

SEQ ID NO: 71166 - DNA, 545 bp, Homo sapiens
  misc_feature: GYAE6OF01B36GG.51.32.C10.1.454.CMB.1.raw
  modified_base (255)..(255): a, c, t, g, unknown or other
  misc_feature (255)..(255): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcacatcacttgccgggcaagacagaacatggcagctaattaatgtatnagcagaaaccgaggaaacgacccctaacctctagatctatcgctgcagacctactttgacgtaaagtggacgtcccgagtcggtaggttcaggtcggcgtagggtggtcgtagggactaggtactttctcttctcacctatacgcagtctgactaacctagtaatatttcgactaacttactactgtaacaacgtagtaattaacatttcgacctatctacttccggaaccgtaagggaccacggtacgaggtaagtaacgttaaacgacgttaggtcggtctacggacc

SEQ ID NO: 71167 - DNA, 527 bp, Homo sapiens
  misc_feature: GYAE6OF01C86FL.51.32.C10.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (257)..(257): a, c, t, g, unknown or other
  misc_feature (257)..(257): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtagganacagagtcaccatcacttgccggnaagcagaacattggcagctatttaatggtatcancagaacaggaaacgccctaacctctgatctatgctgcacgccactttgactaaggtggactcccatcgagttcagtggctagtgggtctggactgtattctctctcactatacgctagtctcgacaactgaacgtattttcgactaacttactaactgtaacaacgtagtacttaactaacttcgaccctaatctaccgttcggaccgtaaacgggactaacggtactaggaacgtaacgttaaacgaacgttggtacggctgtaacccg

SEQ ID NO: 71168 - DNA, 552 bp, Homo sapiens
  misc_feature: GYAE6OF01AJHLW.51.32.C10.1.454.CMB.1.raw
  modified_base (274)..(274): a, c, t, g, unknown or other
  misc_feature (274)..(274): n is a, c, g, or t
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccggcaagacagaacatggcagctatttaatggtatcagcagaaaccagggaaacncccctaactcctgatctatgctgcagccactttgactaaagtggactcccagtcgaggttcaggtggctaggtggtcgtgggactagtatttcnctctcacctagtagctagtcncgactaaccgtagaagttnttttacgactaacttactactgtacaacgtagtacgtttaacagtttcgaccttattcctaccgtttacggacccgtaaggggacctacggtcgtaacgggaagtaaacgttaaaccggacttagggtacggtcttcgaacccg

SEQ ID NO: 71169 - DNA, 826 bp, Homo sapiens
  misc_feature: GYAE6OF01CUMHK.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctccgtggggctcctgctactctggctccgaggtgccagatgtgacatccagatcgacccagtctccattccttccctgtctgcatcgtgtaggagacagacgtccaccatccacgttcggccgggacaagacaagaactagttggacagtacttaatttaaagttggtatcaagacaacgaaaccgaacgggaacctacccctacctccgtagactacgtatcgctcgacgacgaccttacgttacgaacgtaaggtacggtaacccgttacccgtacgtacggtaacgggttacgtacgggttacgggtacgtacggggttcggggttacggtacggggtaacgttaggtttaccgttttaccttccgttaacccgttacctaacgttaacgttacgtaccgtaacgttaccgtacgtaaacccgtaacggttacggtaaacgtttaacgttttaccggtaaccctttaaaccgtttaaccgtttaaccgttaaccgtaaaccgttaaaacgtaacgttttaaacctttaaaccgttaacgtttaccctaaccccgttaactttaccccgtttaaaccgggtttacccgggtaaacccggtaaaccgggtaacccgtaacccggggtaacggttagggttaaaaaccggttaaacggtttaaaacccgggtttaacccggttagggttaccccggtaccgtaacccgggtaacccc

SEQ ID NO: 71170 - DNA, 751 bp, Homo sapiens
  misc_feature: GYAE6OF01DAUO5.51.32.C10.1.454.CMB.1.raw
  modified_base (240)..(240): a, c, t, g, unknown or other
  misc_feature (240)..(240): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtccaccatctacttggccgggacaagacagaactntggcagcttaatttaaatggtatacagacaagaaaccgagggaaaccacccctaactccgtagatctatgctgctacgccctagttagaactaaggtcgactacccagtcggtaacggttcaggtcgcgtagggtggtacgtgggactgtactttccgtcttacgtaccaacgttacgttacgtacgtaagttccgtagacccgtaaaccgttaggtaaacgtttactttttacggaaccctttaaaccgttttaacgttaaccttacggtttaaccgaaacggttaagttaaaccgggttttaacctttaaacggtttccctaaaccccgttcgtttaaaccccgggttacccgtttttacccggggaaaacccggttaaacccggggtaaaccgttaaccccggggttaaacggtttaaccgggggaaaaacgtttaaaacggttttaaaaccccgggtaaaacgggtttccgggttaaaccgggtacgttacccgggttaaaaccccc

SEQ ID NO: 71171 - DNA, 698 bp, Homo sapiens
  misc_feature: GYAE6OF01A8RY7.51.32.C10.1.454.CMB.1.raw
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtaggagacagagtcaccatcacttcggccggganaaagacagaactagttggcagcttaatttaaatggtatcagcaagaaaccgagggaaaccncccctaacctcctgtactctatgctgccacgtcctactttacgacgtaaaggtcggacgtacccagttacggtaggttacgaggttcgggacgtagggttcgggtcgtacggggtactagttacgtttaccttccttccgttacctaacccgttaacgtttaacggtaccgtacggttaccgtaccgtacccgtaaccgttaacggttaacgttaacgttttacgttaaccttaaccgtttaacgttaaccgttacgttaaccgtaaacgtaacgttaacgtttaacgtaacgttttttaccgaccctacgttaccgttaccgttaccggtaaccggtaacggtaacgacggtacgtacggtaacgttaaacgttaaaccgttaacgttacggtcggtcgtcgtacccg

SEQ ID NO: 71172 - DNA, 804 bp, Homo sapiens
  misc_feature: GYAE6OF01ET7QG.51.32.C10.1.454.CMB.1.raw
  modified_base (144)..(144): a, c, t, g, unknown or other
  misc_feature (144)..(144): n is a, c, g, or t
tcagcgatcgtatacacgaccggtgctcgatttagtatagacatcaacacacaaaggggggagtcagtctcagtcaggacacagcatggacatgagggtccccgctcagctccgtggggctcctgctactctggctccgaggtnccagatgtgacatccagatcgacccagtcctacctattccttccctgtcctgcctatctggtaaggacgacaggtactccaaccactcctaccgttcgggaccgggacaaacgacaacgaactagttcggactacgttactttaatttaaagttcggtatacgacgtacgaaaccggaaaccggaacgggaaccctaccccctaaccgtaccgtacgtactacgtacgtcgtctacgacgacgtaccttacgttacgacgtaaaggtcggtacctaccgtacggtacggtacggttacgtaacgggtcggtacggtacgggtttcgggtacggtacgggtaacgttcggttaaccttttcccgtccgtaccttaaccgtacgttagttaacgtcgttaacggttccacggttaaacctaaccggtttaagggtaacctttaggtttaacctaaccctttaacgtttaaccgtacggtttacctaaaccggtaacttaaacggttaccttacttaacccgttccaaccgttaccgttaccgttacccgggttacccgggaaaccggttaccggaaacccgttacggtaaacgggttaaggtaaaccctttaaaacggtaacccggtacggttacggttacccggtaatcccgggttaaacc

SEQ ID NO: 71173 - DNA, 642 bp, Homo sapiens
  misc_feature: GYAE6OF01CJDLC.51.32.C10.1.454.CMB.1.raw
  modified_base (290)..(290): a, c, t, g, unknown or other
  misc_feature (290)..(290): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtaggagacagagtccaccatcacttggccgggacaagacagaacattggacagtcttaatttaaagttggtatcagacaagaaaccgagggaaacnccccctaactcctagactctatcgctgcagcctacttgactaaggtggactccagtcgtaggttcgaggtggctagggtgggtcgtagggactagtactttccgctctacactattacgctagtctacgactaacgtagtaacttagttttacgaccttaacctttacgtacgttacgtaacctaaacgttagtaacgtttaactaacgtttccgaacccctagtttacccgtacccggtttaccgggaaccggtaaacggggtaaccctaaccgggttaacgttaacggggtaaacgttaaaccgtttaaaaaccgggacgttacgggtaccggtacctacggtaaccccg

SEQ ID NO: 71174 - DNA, 708 bp, Homo sapiens
  misc_feature: GYAE6OF01EFOET.51.32.C10.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtcctccattcttccctgtctgcatctagtagganacagacgtccaaccatcacgttcggccgggacaaagacagaactagttggcagtcttaatttaaagttggtatcgagacaagaaaccgaggaaccncccctaacctctagactctatcgctcgcgtacgtaccttacgttacgaacgtaaaggtcggtaaccgtaccctagttaccggtaggtttaccgagggttcggaccgttaggggttacggggttaccgtaggggtaacctaggtttacctttttcccgtaccgtttaccgtacctaacccggttaagtttaccggtacctacgggtttacctacggtaacctaaaccgttagtaacgtttactttttacgtaaccttaaccgtttacttaacgttacgtaactaaacgtaagttaacgtttaactaacgttaccgaccctagttaccttaccggttaccggaacggttaacggaccgtacggtacgtacgtaagttaaacgttaacgtacggttggacgttccgcgtacc

SEQ ID NO: 71175 - DNA, 852 bp, Homo sapiens
  misc_feature: GYAE6OF01B6JG8.51.32.C10.1.454.CMB.1.raw
tcagcgatcgtatacacgaccggtgctcgatttagtatagacatcaacacacaaaggggggagtcagtctcagtcaggacacagcatggacatggacggggtccccgctcagctccgtggggctcctgctactctggctccggaggtgccagatgtgacatccagatcgacccagtcctccattccttccctgtctgctatcgtggtaggagacgagacgtaccaacctactccgtacgttcgggaccgggacaaacgacgaagaactaggttcggacgtaacggtactttaaagttttaaagttgggtaactaccgaacggaaccgtaaacgggaaaaccggtaaacggggaaacccgtacccccttaaaccgtaccgtacggtacttacgttacgtcgtaccgtacggaccgtaaccggtacccttaacggtttacgaaacggttaaacgggttacggtaacccggttaccccgtaacggttacgggttaacggtttacggtaacgggttacgggtacgggttacgggtttcggggggttacgttaacgggggacttacgggttttacctttccgttacctaccgtaccgttacgttaagttacggaccgttcgttaccgacgtaaccgttaaacgttaggtaaacgttttcgtttaaacgacccctttaaactttaacgtaccgttaacgtaaccgtaagttaacggtttaactttaaccttaacgtttcccaaccctttagttacccgttacgttaaccgggaaccggtaaacgggtactacggttaacgggtacgtaaaggttaaaccgttaaacgggtattacgggtacgtaccggtcgtaaaccc

SEQ ID NO: 71176 - DNA, 709 bp, Homo sapiens
  misc_feature: GYAE6OF01B3JW0.51.32.C10.1.454.CMB.1.raw
  modified_base (205)..(205): a, c, t, g, unknown or other
  misc_feature (205)..(205): n is a, c, g, or t
  modified_base (342)..(342): a, c, t, g, unknown or other
  misc_feature (342)..(342): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccggaggtgccagatgtgacatccagatcgacccagtctccatccttccctgtcctgctatctggtagganacagacgtccaccatccacgttcggaccggggacaaacggacaaggaactagttcgggactagtaccttattttaagttggtagtacagacaacgaaaccgacggaaaccgtcccctaactctagacttactgtacnctcgctacgcctacttcgacgtaagtcggactcccgaatcggtacgttcgaggtagtcggtagggtcggggtcgtacgggtactaacgtttgtttccctacgttacctacctaacgttaagtcgtacctagttccgtacggtaacctaaccggtagtagttaacgtttcaacgtttaaccttaccttggttaaacctacgtaaacgttaggtaactttaaacgttacgtttacccgacctaacgtttccccgtaacggtttaccccgggaaccgggtaaacggttaacccggacgttaacggttaaacccgggtaaattaaacccgtttaaaggaaccggttggtacgtaaccggtcgtaaaccccg

SEQ ID NO: 71177 - DNA, 581 bp, Homo sapiens
  misc_feature: GYAE6OF01AU5SU.51.32.C10.1.454.CMB.1.raw
  modified_base (257)..(257): a, c, t, g, unknown or other
  misc_feature (257)..(257): n is a, c, g, or t
  modified_base (276)..(276): a, c, t, g, unknown or other
  misc_feature (276)..(276): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttcctgtctgcatctgtaggagacagagtcaccatcacttgccgggacaagacagaacattggcagctaattaaatggatnagcagaaaccagggaaacncccctaactcctgactctaatgctagcagccaagtttcgactaaaagtggactcccagtcgacggttcaggttgctaggtgggtacctaggggactagtagtttctctcgtacacctaattagacacgttcacgtaccaaacgtcgtaagtacgttttcgacttaaccgttaactacgtatacaaaccgtaggtaacgtttactaagtttcaccctataccttaacgtttccgggaccgtaaacgggacaaccggtagtaacggaataaacgttaaaccggaacttaggtcgacgttcgaacccg

SEQ ID NO: 71178 - DNA, 660 bp, Homo sapiens
  misc_feature: GYAE6OF01B8JX8.51.32.C10.1.454.CMB.1.raw
  modified_base (235)..(235): a, c, t, g, unknown or other
  misc_feature (235)..(235): n is a, c, g, or t
  modified_base (490)..(490): a, c, t, g, unknown or other
  misc_feature (490)..(490): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatcgacccagtcctccatccttccctgtctgctatctggtaggagacagactcaccatccacgttcggccggganaagacagaactagttggacagtacttaattttaagttggtactacgagacaaacggaaaaccggaacgggaaacccacccccttaaccgtctagtacttactactcgctaggaccacgtaccttaacgttgaacgtaaggtcgacgtaccctagtcgtaggtcaggtcggcgtagggtggtacgtcggactagttactttcctcgtaccttaccgactaagttcgactagttcctacgactaacgtgtaacgttnttagactacttaccttacttacgtactaacgtaacgtaacgttacgtttaactaccttcgtaccctattcccgttaacgttacccgggacgtaaaccggttcgaaacccggttaggtaacggtaaagttaaaccgttaacggtaaccggtttcggtacgtaccgtaaccg

SEQ ID NO: 71179 - DNA, 580 bp, Homo sapiens
  misc_feature: GYAE6OF01DPCAX.51.32.C10.1.454.CMB.1.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (285)..(285): a, c, t, g, unknown or other
  misc_feature (285)..(285): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
  modified_base (573)..(573): a, c, t, g, unknown or other
  misc_feature (573)..(573): n is a, c, g, or t
tcagcgatcgtatacacgaccggtgctcgatttagtatagacatcaacacacaaagggggagtcagtctcagtcaggacacagcatggacatgagggtccccgctcagctccgtggggctcctgctactctggctccgaggtgccagatgtgacatccagatgacccagtctccattcttccctgtctgcatctgtaggagacagagtcaccatcacttggccgganaagacagaacngttggcagtcttaatttaagtgtatcagacaagaaacgagggaaccncccctaacctctgactctagtcactgacacgtcctactttgacgtaaggtgactacccagttcggtagttcgagtgcgtaggtggtacgtgggactagtactttcgcttctacactatacgntacgtctagacctaacgtntaagttctttagacctaacgtttactacgttcgtaacaagtagttaacttactaactttaccgaccctaattccgtaaccgttcggaccgtaaagggtaccacggtacggtaacggaataaacgttaacgacgttgggtacgtcgtntaacccg

SEQ ID NO: 71180 - DNA, 739 bp, Homo sapiens
  misc_feature: GYAE6OF01DDUBH.51.32.C10.1.454.CMB.1.raw
  modified_base (141)..(141): a, c, t, g, unknown or other
  misc_feature (141)..(141): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
tcagcgatcgtatacacgaccggtgctcgatttagtatagacatcaacacacaaagggggagtcagtctcagtcaggacacagcatggacatgagggtcccgctcagctcctggggctcctgctactctggctccgaggtnccagatgtgacatccagatcgacccagtctaccattccttccctgtctgcatctggtaggagacagtacgtccacctntctacgtcggccggganaagacaggaactgttcggacgagtacttaatttaaacgttggtactacgagacaacgaaaccgaaggggtaaccaccccgtaacctccgtagaacttacgtatcggtaccttcggacaccgtaccgttaacgtttacggaaccgtaaaggttaccggtaaccgtaccccgtaacggttaccggtaaacgggtttccgaacgggtacggtcggttaacgggtcggggttacgttagggaccgtagttacgtttaccgtcctacctaccgtaaccgttacgtttacggaccttacgttaccgtacgtacccgttaaacggttagtacgtttacgttttacgaacctttaaccgtttaacgtactacggaacctaacgtagttaacttaacttaccgtttacgacccttacttaccgacggtttcggaaccggtaacggaacgtaacggtacggtaaggtaaccgttaaacttaaccggttaacgtcggtacgtcgtcggtaaccc

SEQ ID NO: 71181 - DNA, 874 bp, Homo sapiens
  misc_feature: GYAE6OF01ALO86.51.32.C10.1.454.CMB.1.raw
  modified_base (235)..(235): a, c, t, g, unknown or other
  misc_feature (235)..(235): n is a, c, g, or t
  modified_base (847)..(847): a, c, t, g, unknown or other
  misc_feature (847)..(847): n is a, c, g, or t
tcagcgatcgtatacacgaccggtgctcgatttagtatagacatcaacacacaaagggggagtcagtctcagtcaggacacagcatggacatggacgggtccccgctcagctccgtggggctcctgctactctggctccgaggtgccagatgtgacatccagatcgaccctagtcctcctacttccttccctgtcctgcctagtcgtaggtaggagacgaggtacgtaccaaccntccgtaccgttacgggacccggggaacaaacggaacgtaagtaacgtacggttcggaaccgaaggttaaccttttaaagttttaaaaggttcggttaaacgttaccgaacggtaaccgaaaaccgggtaaaacccgggtaaacggggaaaaacccccggtttaccccccttaaaacctttaccggtaacgtacgttacttacggtcggtactccggttaaccgaacccgttaccgttaacggtttaacgaaccggtaaacgggttccggtaacctaccccggtaagttacccgggtaacgggtttacgtacggtcgggtacggtagggttacggggttacggtagggtaccgttagttcctttacccgtacgtaccttaaccggtaccgttacgttacggtacgtacggtttacgcgtaaccgtaacgttaaggtaacgttttacgttaacgttaaccttaaccgtttaacgtaccgttaacgtaaccgtagttaacgttaacgttaacttaacgttacccgtacttaaccgttccgttaaccggttaccggaaccggtaacgggtaccgtaacggtaccgtaaaggttaaacgttaaacgttaaaccgggnggtttacggacttacgtaacggtaccc

SEQ ID NO: 71182 - DNA, 683 bp, Homo sapiens
  misc_feature: GYAE6OF01DZUWZ.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctccatccttccctgtctgcatctgtaggagacagagtcaccatcacgttggaccggacaagacagaacagttggacagtacttaagttttaagttggtaactcgagacgaacgaaaccgaagggaacctacccctaaccgtcctagactacgtagtcgtcgtcgacgacgtacctacgtttagacgtaaggtggtacctacctagtacggtaggttacgacggtggacgtagggttcgggtacgtaggggtaactacggttacttttcctaccgttacctaccgtaaccgttagtttacgggacttacggtcctacggtaacctaacgtaagttaagttacgttttacaacctttaactttacgttacttaacgtaacaacgtagttaacctttaactaacgtttaccgaccctagttaccgttaccgtttacggaaccgtaagggtaccaccggtaagtaacggtaacttaaacgttaaaccggtacgttagggtccgtacgtcgaacccg

SEQ ID NO: 71183 - DNA, 647 bp, Homo sapiens
  misc_feature: GYAE6OF01CAB1N.51.32.C10.1.454.CMB.1.raw
  modified_base (200)..(200): a, c, t, g, unknown or other
  misc_feature (200)..(200): n is a, c, g, or t
  modified_base (295)..(295): a, c, t, g, unknown or other
  misc_feature (295)..(295): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatgacccagtctccatcttccctgtctgcatctgtagganacagagtcaaccatcacttggccgggacaaagacagaacagttggacagtacttaatttaaagttggtatcgagcaaagaaaccgagggaaaccnccccgtaacctcctagacttctatgctggcacgtacctacgtttgacgtaaagtcggaactcccgtagtaccggtaggttcaggtcggacgtagggtgggtacgtagggactagttactttacgtccttctaccgtacctagttaacgcgtagtctacgactaaccgtaggtaactttagttttacgacttaaccgttacgttacttacgtacaaacgtaggttaacttaacgtaatttccgacccttataccgttaccgttaacccggaccgtaacgggaacctacggtaacgttaacgggtaattaaaccggttaaaaccggacgttagggttcgtaccgtgtaaccccg

SEQ ID NO: 71184 - DNA, 661 bp, Homo sapiens
  misc_feature: GYAE6OF01D9LOV.51.32.C10.1.454.CMB.1.raw
  modified_base (354)..(354): a, c, t, g, unknown or other
  misc_feature (354)..(354): n is a, c, g, or t
  modified_base (656)..(656): a, c, t, g, unknown or other
  misc_feature (656)..(656): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgaccctagtcctcctattccttcccgtgtcctgctactctggtaggacgacgagacgtccaccactctacgttcggccggacaacgacaagtaactagttcggactacgtactttaattttaagttggtactcgagacaacggaaaccggaacgggaaaccgtaccccttaacctccgtagtactctactcncgtcgactacgtaccgttacttacgacgtaacggtcggtacgtaccctacgtacggtacggttcgtaggtggacggtagggttcgggtacgtacgggtattacggtttctttcccgttcccttacctacttaaccgtagttaccggaccttacggttcccaagaccgttaacgtagttagtttacctttacgtaacctttaacgttcctagttactaacacgttattaacgttactaaccgtctacctcgttcgtaccgtacgacgtagacgtacgctaagtacgaagttacgataggcgtntcgac

SEQ ID NO: 71185 - DNA, 603 bp, Homo sapiens
  misc_feature: GYAE6OF01AZTGC.51.32.C10.1.454.CMB.1.raw
  modified_base (275)..(275): a, c, t, g, unknown or other
  misc_feature (275)..(275): n is a, c, g, or t
  modified_base (398)..(398): a, c, t, g, unknown or other
  misc_feature (398)..(398): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatgtatcagcagaaaccagggaaancccctaactcctgatctatgactgcagccatttgcaaagtggagtcccatcgagttcagtgcagtggctgggacagactttctctctcaaccatttacgctaagtctagcaaacctgaaagtnttttacgactaaaccgtttactacttaggtacctaaacgtagtaacgtttaaaccaattttaccggaccccctaaattcccgtaaaccgtttttcccgggaacccgtaaaacgggggacctaaaccgggtaaccgttacgggtaaaaccggttaaatttaaaaaaccccgggaacttggggttaacggtccgttaggtaaacccc

SEQ ID NO: 71186 - DNA, 762 bp, Homo sapiens
  misc_feature: GYAE6OF01CHEA8.51.32.C10.1.454.CMB.1.raw
  modified_base (143)..(143): a, c, t, g, unknown or other
  misc_feature (143)..(143): n is a, c, g, or t
  modified_base (156)..(156): a, c, t, g, unknown or other
  misc_feature (156)..(156): n is a, c, g, or t
tcagcgatcgtatacacgaccggtgctcgatttagtatagacatcaacacacaaagggggagtcagtctcagtcaggacacagcatggacatggagggtccccgctcagctctggggctcctgctactcgtggctccgaggtnccagatgcgaacntccagatacggacccagtcctcacgttccttcccgtgtctcgacctattcgaggtacggagacgaggtactaccaactatacccgtacgttaccgggacccgggaactaaacggaccgaagtaaccgtaggttcggaccgtaagttacttaaagtttaacgttaggtactacgacgtacgaaacggaaccgaaacggtaacccgacccttacgtactacgtactacgtacgcgtctacgaccgtaccggtaccttaagtacgaacgggtaacggtaccggactacccggtaggttaccggtaggtaccgtggtaccggagtacgggttaggtacgtaggggaacctgttaactttcccgtattacccgacttaccgtaaggttccgacgtacgtacctacgtaaccgtaaccgttaggtaatttccgtttaacgacctttaaacgtacgtttaccgaacgtacaaacggtttacgtaaccgttacttaccgtaccggtaccctaacttacccgtacggttaccgaaaccgggttaccgaaggtaccgaaccggtaagtaaccggttaacggtaaaccgtacttacgggaccgtcgtaacggtaccc

SEQ ID NO: 71187 - DNA, 884 bp, Homo sapiens
  misc_feature: GYAE6OF01DZRCV.51.32.C10.1.454.CMB.1.raw
tcagcgatcgtatacacgaccggtgctcgatttagtatagacatcaacacacaaaggggggagtcagtctcagtcaggacacagcatggacatggacgggtccccgctcagcctccgtggggctcctgctactctggctccgaggtgccagatgtgacatccagatcgacccagtctcctatccttccctgtctgctatcgtaggtacggagacgagtacgtaccacctactaccacgttcggaccgggacaaaggaccaagtaaccgtagtttcggactacgttactttaagttttaagttaggtactacgacggaccgaaacggtaaaaccggaacggggaaacccctacccccgttaaccgtccgttaacggtactttaccgtactcggtaccgttacggaccgtaaccgttacccgttacggtttacggtaaaccggttaaaacgggttccgggtaacccgttaccccgtaagggttaccgggtaacgggtttaccggaagggttacgggtacgggtacgggggtttcggggttaccggtaggggtaaccgttacgtttacgtttacccttacgtttacccgtaacgttaaacccgttagttaccgtacgttaaccggttacgtacgtaaaccctttaacggtagttaacgttttaccggtttaacctaaccgtttaacctttaaccgttaacgtaaccgttaactaacgttaaggtttaaccgttaaccttaaccgtttaccgaacccttaaacgtttcccgttaacccgggttaccgggaaacccggtaaaccgggttacctaacggttacggtaacccggttaaaggttaaacccgttaacgggtaacttacgggtactacccgtaacggtaacccc

SEQ ID NO: 71188 - DNA, 659 bp, Homo sapiens
  misc_feature: GYAE6OF01EKOMZ.51.32.C10.1.454.CMB.1.raw
  modified_base (114)..(114): a, c, t, g, unknown or other
  misc_feature (114)..(114): n is a, c, g, or t
  modified_base (248)..(248): a, c, t, g, unknown or other
  misc_feature (248)..(248): n is a, c, g, or t
  modified_base (296)..(296): a, c, t, g, unknown or other
  misc_feature (296)..(296): n is a, c, g, or t
tcagcgatcgtatacacgaccggtgctcgatttagtatagacatcaacacacaaagggggagtcagtctcagtcaggacacagcatggacatggagggtccccgctcagctccnggggctcctgctactctggctccgaggtgccagatgtgacatccagatcgacccagtctccatccttccctgtctgcagtctgtagagacagacgtcacatcacgttggccggacaagaccagaacagttcggnagctttaattaaacgttggtatcgagacaacgaaaccgaggtaaaccncccctaaacctccgagtatcgttatgctggaccaacgtccttacgtttcgaaccgtaaaggttcggaccgtccctagtccgtaggttcaggttcggacgtagggtgggtacctagggaacttacgttactttcctaccgttcctacctaccgttacgtacgtacgtacgttaccgtacgtacccgtaacttaggttaacttaacgtttctaaccttaacgttactttacgtacttacgaactacgttaacggttactttacgtacacccgttaacttccggttaactttcccgggaacgttaacggaccgtaacggtcgtacggtaaattaaccgtaaagtacttagggtcgtcgacggtacc

SEQ ID NO: 71189 - DNA, 656 bp, Homo sapiens
  misc_feature: GYAE6OF01CSW76.51.32.C10.1.454.CMB.1.raw
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
  modified_base (643)..(643): a, c, t, g, unknown or other
  misc_feature (643)..(643): n is a, c, g, or t
tcagcgatcgtatacacgaccggtgctcgatttagtatagacatcaacacacaaagggggagtcagtctcagtcaggacacagcatggacatgagggtccccgctcagctccgtggggctcctgctactctggctccgaggtgccagatgtgacatccagatcgacccagtcctccattccttccctgtctgctatcgtggtaggagtacaggacgtccacctatccgtacgttggacccgggacaaaggaccaagaactacgttggactagtactttaatttaaagttgtatacgacgtacgaacggtaaacccgaaggggaaaccctacccccgtaacctccgtagtacgttactagtcgtcgtcgactacgaccttacgttagacgtaaggtcgtactccgagtcgtagtcgaggtcgngtagtcggtcgtaggactntacttcnctctacacttagtcgtactacgtccgtacacgttaacctaggtaattactttacgaaccttaacttaccgtaataccgtaacgaacgttagtaacgttaactcgttacgtaacctgttaacccgtaccgttacggaacgtaacggactacggtacgttaacggaagttaaccgttaaaccggtgtacgggttacnccgtaagtacccg

SEQ ID NO: 71190 - DNA, 699 bp, Homo sapiens
  misc_feature: GYAE6OF01DVCOZ.51.32.C10.1.454.CMB.1.raw
  modified_base (289)..(289): a, c, t, g, unknown or other
  misc_feature (289)..(289): n is a, c, g, or t
  modified_base (340)..(340): a, c, t, g, unknown or other
  misc_feature (340)..(340): n is a, c, g, or t
  modified_base (468)..(468): a, c, t, g, unknown or other
  misc_feature (468)..(468): n is a, c, g, or t
  modified_base (690)..(690): a, c, t, g, unknown or other
  misc_feature (690)..(690): n is a, c, g, or t
tcagcgatcgtatacacgaccggtgctcgatttagtatagacatcaacacacaaagggggagtcagtctcagtcaggacacagcatggacatgacgggtccccgctcagctcctggggctcctgctactctggctcgaggtgccagatgtgacatccagatcgacccagtcctccattccttccctgtctgcatctagtaggagacgagacgtacaccatcctacgttcggaccgggtacaaagaccaagaactagttgacctagtacttaaagtttaacgttggtaanccgagaccaaggaaaaccccgaagggaaccctaccccgttaacctccgtanaactttcgtaacgtcgcgtcggacctacgtacccgttacgtttacggaaactaaacgggtcgaaccgttaacccgtagttacggtacggtaccgtaagggttcggacggtaacgggttgggttaccgngggtataccgtttgtttacctctacctacgtacctaagttacgccgttaagtcctaacgtacctaaccggttagttaaccgttgttttaaccaaccttaactttacgtactacggtactaaataccggttaaattaaccgtattacccgactaaacgttcgtaaccttacgggaactacgggactacgggaactggtaaacgtactaacggtacttagcgtntaccgtacg

SEQ ID NO: 71191 - DNA, 679 bp, Homo sapiens
  misc_feature: GYAE6OF01D1ZCL.51.32.C10.1.454.CMB.1.raw
  modified_base (218)..(218): a, c, t, g, unknown or other
  misc_feature (218)..(218): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (465)..(465): a, c, t, g, unknown or other
  misc_feature (465)..(465): n is a, c, g, or t
tcagcgatcgtatacacgaccggtgctcgatttagtatagacatcaacacacaaagggggagtcagtctcagtcaggacacagcatggacatggacgggtccccgctcagcctccgtggggctcctgctactctggctccggaggtcgccagatgtgacactccagatcgaaccctagtcctccacttccgttccctgtctgccattcgtagtagganaacgagacgtccacctatacctacgttcggaccgggaacaacgtacaagaacttagttacgggactagtaccttaaagttttaaacgtgtactacagacaacggaaaccgaagggaaacctaccccgttaacctccgtagtactactacnggtacncgacgacgtcctagttacgacgtaagtcggactccgagttacgaggttcgacggtacggcgtggttcggtcgtaggtaactgttctttccnccttacacctacgttagtcgacttggtccagtaaccgaacgttgtaacgtttattacgaaccctaacgtttacacggttacaacgtacgtaattaacgtttaacgttacttaccggccttaacgttccgttccgtaaccgggaaccggacgttacaaccggttagtaacggtagtaaaacgttaacggacgttaacgtcgacgtaacgtacccg

SEQ ID NO: 71192 - DNA, 894 bp, Homo sapiens
  misc_feature: GYAE6OF01BKSVJ.51.32.C10.1.454.CMB.1.raw
  modified_base (130)..(130): a, c, t, g, unknown or other
  misc_feature (130)..(130): n is a, c, g, or t
  modified_base (204)..(204): a, c, t, g, unknown or other
  misc_feature (204)..(204): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactntggctccgaggtgccagatgtgacatccagatcgacccagtcctccatccttccctgtctgctatctgtagganacgagagtccaccatcacgttcggccggacaagacaacgaacagttggacagtactttaaagtttaaagttggtactacgacgacgaacggaaacccgaagggaaaccctacccccgtaaccttcctacgtacttacctagtcggtccgtcgtacgaccgtacccgttacgtttacggaacgtaaacgggttcgaacccggttacccctaggttaccggtacggttacggtaacggttcggggtacggtaggggtttcggggtaccgggtacggggtaacttagggttaacccttttcgtaccctttaccgttacccgtaacctttacggttaacggtccgttaacgttccgtaccgtaaccgttaaaccgtttaacgggttaacgtttaacgttttaaccgtaacccgtttttaaaaccgtttaccgttaacccgtttaaggtaaaccccggtaaaacggtttaacggttaaacccggtttttaaaaccctttaacggtttaccccccgtaacccgttttaacccggttaccgttttacccccggggttaaacccggggtaaacccgggtaaaacccgggggtacccttaaaacgggttacccgggtaaaagggttaaaacccggttaaacccgttaaaaaccggggttcggttttagggaaccccggttccgggttaacgtacccccg

SEQ ID NO: 71193 - DNA, 810 bp, Homo sapiens
  misc_feature: GYAE6OF01C8DQK.51.32.C10.1.454.CMB.1.raw
tcagcgatcgtatacacgaccggtgctcgatttagtatagacatcaacacacaaagggggagtcagtctcagtcaggacacagcatggacatgacgggtccccgctcagctcccgtggggctcctgctactcgtggctccgaggtcgccagagtgtgacactccagatcgacccagtcctcctacttccttccctgttctgctatcgttaggtagagaccagacgtaccaccactccgtaacgtttcggacccggggaccgaaagacgaaacggaaccttaacggtttggaacgtacggttactttaaacgtttttaaagtttacggttacttaccgaaggtaaccgaaaaccgggtaaaacccggaaacgggggtaaaccccggtaacccccttaacccttaccgttacggtaaccttactagtccggtactcggactacccgtaccgtttacggttagaacgttaacggacggtaccgtcccgtaagttcggtacgttcggtaggtggtcggtaggtcgggttcggacggtacgttacggttacgtttcctaccgttacccgttactaaccgttagttaacgacgttacgtacgtactaacccgtaaaccgtttaggtaaacgtttctttaccggtaacctttaacgttaacttacggtaacgtacctaaaggtagttaaccgttaattacccgtcttaccgttacttacccggttaccgttacccgggacgtaaccgggacttacggtaacgttacggtaaaacgtacggttaaacgttaacggtcgtttacgaccgtccgtaaccg

SEQ ID NO: 71194 - DNA, 741 bp, Homo sapiens
  misc_feature: GYAE6OF01C5Q0S.51.32.C10.1.454.CMB.1.raw
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (236)..(236): a, c, t, g, unknown or other
  misc_feature (236)..(236): n is a, c, g, or t
tcagcgatcgtatacacgaccggtgctcgatttagtatagacatcaacacacaaagggggagtcagtctcagtcaggacacagcatggacatgacgggtccccgctcagctccgtgggggctcctgctactcgtggctccgaggtgccagatgtgacatccagatgacccagtcctccattccttcccngtctgcatctggtagganacagacgtcaccatcacgttcggccgganaagacaagaactagtgcagtcttaatttaagtgtatcagcaacgaaaccgtaacgggaaacctcccctaactctagacttacgtatcgacgttcgaccacgtaccttacgttacgaacgtaaaggttccggtaaccttacccgtaacggttcggtaaacggttttccggaaaggttcgggacgtttaagggtcgggttaccgttacggggtaacgttacggtttaaccttttccgtccctttaacccgtaccttaaaccgtagtttaacccggagttaccgtactacgggtacccctaaaggttaacgtacgtttaattttcgaacccttaagtttaccgtaagttaccggtaactaaaccgttagttaacgtttaaccgttaacttccgtaaccttacgtaacgttacccgtttaccggaacccgggtaaacggtacctaacgggtaattaccggaaagttaaacccgttaaaacggacttcggtaacggccgttacgaacccg

SEQ ID NO: 71195 - DNA, 598 bp, Homo sapiens
  misc_feature: GYAE6OF01E3GXY.51.32.C10.1.454.CMB.1.raw
  modified_base (194)..(194): a, c, t, g, unknown or other
  misc_feature (194)..(194): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (462)..(462): a, c, t, g, unknown or other
  misc_feature (462)..(462): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcattcngtaggagacagacgtccaccatctacgttggcccgggacaaagacagaacagttggccagtcttaatttaaagttggtatcagcaacgaaaccgagggaaacncccctaactctagactctanctctgcacgcctattagacgaaggtcgactaccagtcgtacggttcaggttgacgtaggttcgggtactggggtactaagtttcttcctactccttacaaccttagttaccgcgtagttccacgtacctaaccgtagtaactttntttaccgaacttaacttacgtactagacctaagtaagttacttactaactttccgaccttatccttaccgtaccggaacggtaacggaccacggtctaaggaacgtaaagttaaaccgcgttagcggcctgtaccc

SEQ ID NO: 71196 - DNA, 565 bp, Homo sapiens
  misc_feature: GYAE6OF01BXYYA.51.32.C10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtagganacagatcaccatcacttgccgggacaagacagaactattggcagtctaatttaatggtatcagcaagaaacccagggaaacgtccccctaactcctagactctatcgactgacagcctactttgactaaaggtcggaactcccatcggaggtttcaggtcggactaggttgggtctaggggactaggtactttcgtctctacactattacgctagtctgacctacgtgtaatctttacgactaactttacacttcgtacaacgtagttacttaacagtttccgacccttagtcctacgtttaccggaccgtaagggtccaacggtcgtaggaacttaacgttaaacgacttaggcgtctgtacccg

SEQ ID NO: 71197 - DNA, 892 bp, Homo sapiens
  misc_feature: GYAE6OF01EKI0M.51.32.C10.1.454.CMB.1.raw
  modified_base (61)..(61): a, c, t, g, unknown or other
  misc_feature (61)..(61): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (255)..(255): a, c, t, g, unknown or other
  misc_feature (255)..(255): n is a, c, g, or t
tcagcgatcgtatacacgaccggtgctcgatttagtatagacatcaacacacaaagggggngtcagtctcagtcaggacacagcatggacatgagggtccccgctcagctcctggggctcctgctatctggctccggaggtgccagatgtgacatccagatcgacccagtctccattccttcctcgtctgctatctaggtagagacgagtactcacctancctattcggccggtacaaganaacgaactagttgngcgtacttaatttaagttaggtactacgacacgaaacaaaccggaaggaacccgtaaaccccgtacctaccttacgtactacttactcgtacgtcgtcgaaccgcaacgtttttcgaccgttaaaaacgtcgggtaaacgttcccccgtaaagttcccgtaaggggttttcccaaaggttcgggggtcctaaacgggggtttacggggttacccggttagggggtaaccctaggggttaaccttttccggttaccctttcccgttacccgtaccccgttaaacttttaaccggcgttaacggttacccttagggaccctaaacccgtttaggtaaaacccgttaacgttttttacggtaaccgtttaaaaccgtttaacccgttaaaccggtttaccgttaacccgttaaaacccgtaacgttaaaaccgggttttaaacccttaaaacgtttttacgggtaacccccctttaacggtaccccgtttaaaccgttttaacccgggtaaccccggttaaaccggggtaacccggttaaacccggggtaaaccgttaccgggtaaacgggttaacgtttaaaaaccccgggtaaacgttaaaccgggttaacgggttaaccccgtttagggtaaccccg

SEQ ID NO: 71198 - DNA, 558 bp, Homo sapiens
  misc_feature: GYAE6OF01BV0LK.51.32.C10.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (463)..(463): a, c, t, g, unknown or other
  misc_feature (463)..(463): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttcgccgggcaagacagaacattggcagctatttaattggtatcagcaagaaaccgagggaaacgcccctaacctcctnatctatgctgcngacctatttgacaaagtggactcccgatcgtaggttcaggtggcgaggtcgggtgtgggactagtatttctctctcactatagctagtctcactaacctgtaacgttatttcgactaacgttactactactactaacgtagtaacttactaatttcncccttaattaccgtaccgtttccgggaaccgtaacgggactaccggtagtacgggtaagtaacgttaaacgacgttaggacggtcgtcgtacccg

SEQ ID NO: 71199 - DNA, 926 bp, Homo sapiens
  misc_feature: GYAE6OF01AWI75.51.32.C10.1.454.CMB.1.raw
  modified_base (900)..(900): a, c, t, g, unknown or other
  misc_feature (900)..(900): n is a, c, g, or t
  modified_base (912)..(912): a, c, t, g, unknown or other
  misc_feature (912)..(912): n is a, c, g, or t
tcagcgatcgtatacacgaccggtgctcgatttagtatagacatcaacacacaaagggggatcagtctcagtcaggacacagcatggacatggacgggtccccgctacacgtctccgtggggtcctcctgtcttactcgtggcctccggaggtacgccgtaagtattcggtacgaactactaccaaggtaactccgaacccgtacgtcctaccttacctttcccgttcccgtgttcgtcgtactagttcgttaaggtaaggaacgtacgaacggactaccctaacgtcgtaccgttacggtccgggaccggaacaacgtaacgtaacgtaacgtgttacggaacgttacttaacgtttaaaagttttaagttacgtctaagacgtaaacggtaaaaccgaaaccgggtaacggaacccctccccgtttaacgtaccgtaacgtttacgttacttggtccgtaccggaccgtcgttaaaccgtccgtttaaggtaccgtaggggtaacccgttagtacccgtcgttaaggtacggttacctagggtcggttacggcgggttagggttaccggtaacggttacgggtacccttaagtttccttaccggttaccctacgttaaccgttaacgttaccgttaaccggtcgtaacgttccggtaacctacggtttaaacgtacgtttaacttttaccggtaaaccgttttaactaaccgtttaccttacggtaaacccgttaacgttaaccggttaacgttttaaacgttacccgtttaacgttaccccggttaaccgttacgttaaccccgggttacgttaacccggtaaacccgggtaaactagggtttaaacccgtcgggttaaaagttaaacccggttaaggtaacgtttaaccggggttntaacccgggttnaaaccggttacccg

SEQ ID NO: 71200 - DNA, 701 bp, Homo sapiens
  misc_feature: GYAE6OF01ETY7J.51.32.C10.1.454.CMB.1.raw
  modified_base (694)..(694): a, c, t, g, unknown or other
  misc_feature (694)..(694): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctcggaggtgccgagatgtgacatccagatgacccagtctccatccttccgtgtactgctatcgtaggtaggagaccgagacgtacctaccatcgtacttcgggaccggactaagacaacggaactagttcggacaacgtacctttaaatttaaagttcgggttatacgtaacggacaaacggtaaaccggaacgggaaccgtaccccctaacctccgtagtacttactagtacgtcgtagcgaactccgtagttacgaagtaacggtcggtacgtccgtaacgtcgggtacgttacgacggtggtacggtcgggtacgggtctacggggacttacgtacgtttcctaccgttactaccgtactagtacgtcgtactacgtcgtaactacgtataacgtacgttttacacttaacgttactagtaactaaccgtaacgttaacgttacgtttaacttaaccgttacctaccgttaccttccgttaacccggttaaccgtaaccgggtaacggactaaccggtagaaacggtaacgtaaacgtaacgacggtacgcggttacncgtaacg

SEQ ID NO: 71201 - DNA, 790 bp, Homo sapiens
  misc_feature: GYAE6OF01BI5R4.51.32.C10.1.454.CMB.1.raw
  modified_base (606)..(606): a, c, t, g, unknown or other
  misc_feature (606)..(606): n is a, c, g, or t
  modified_base (777)..(777): a, c, t, g, unknown or other
  misc_feature (777)..(777): n is a, c, g, or t
tcagcgatcgtatacacgaccggtgctcgatttagtatagacatcaacacacaaagggggagtcagtctcagtcaggacacagcatggacatgacgggtccccgctcacgcctccgtggggcctcctgctactcgtggctccggaggtcgccagactgtcgacactccgagactcggacccagtcctcctacgttccttcccgtggtctcgacctagttccgtaggtaacggagacgaggtacgtaccaacctactccgtacgttacgggaccgggacaacgaacaacggaacgtacgttggacacgtacttaaagtttaagtcggtatacgaagaccgaaacggaaccgaacggtaaacccgtaccccttaaccgtcctagacttactacgcgtcgttacgacgtacctaccttacgttacgaaccggtaaggtcggtacccgtacgtaacggtcggtaacggttcgaaggggtacgtacggttaggggtaccggttacggtacgggtaacgttattaccgtttttccgcgttaacccgttacccgaatttacgggtacctacgtcggttaccgaccctaccgttaacggtagttaaccggtttnttacgaacttaacctttgacccgtagaaacccgtagtaacggttaacgtttaactaccccggttagtaaccctcgttaaccggttccggtaaacccgggagtaaaccggggttactaaccggtagggtaaacgtaaacgtaaacgttaccgtagggttcccgaaccgggtnttaacccgaaccg

SEQ ID NO: 71202 - DNA, 804 bp, Homo sapiens
  misc_feature: GYAE6OF01BNX8Y.51.32.C10.1.454.CMB.1.raw
tcagcgatcgtatacacgaccggtgctcgatttagtatagacatcaacacacaaaggggggagtcagtctcagtcaggacacagcatggacatgagggtccccgctcagcctcctggggctcctcgctactcgtggctccggaggtgccagatgtgacatccagatcgacccagtctccattccttccctgtctgcagtctaggtaggagacaggacgtccaccatcctacgttcggaccgggacaagacgaagaactagttggacgagtacttaagttttaaagttggtattacgagacgaaacgaaaccggaacgggaaaccgtacccccttaacctccgtagtaacttactagttcgtacgtacggccgtaaccgtccctaaccgtttacgaaccggtaaacggttcgggaacccgtcccgtaaggttaccggtacggttaccggtagggttcgggacggttacggggttacggggtccggttaacggggtacctaagggtttactttacccgtccttacccgtactaacccgttattaccggcttacggttcctacggaacccttaacgtaggttaatttactttacggaaccctttaacctttacgtaacgtacgtaacctaaacggttagtaggtttaaaccttacgttaccgaacccgttacttacccggttacccgtttacccgggaaacccggtaacgggtaacccggttaaacggtaccggttaacgggtaaactttaaacccgggttaaaacccgggttagttacggggtaccggtacctccgggtaaacccc

SEQ ID NO: 71203 - DNA, 782 bp, Homo sapiens
  misc_feature: GYAE6OF01CQB3U.51.32.C10.1.454.CMB.1.raw
  modified_base (244)..(244): a, c, t, g, unknown or other
  misc_feature (244)..(244): n is a, c, g, or t
  modified_base (287)..(287): a, c, t, g, unknown or other
  misc_feature (287)..(287): n is a, c, g, or t
  modified_base (351)..(351): a, c, t, g, unknown or other
  misc_feature (351)..(351): n is a, c, g, or t
tcagcgatcgtatacacgaccggtgctcgatttagtatagacatcaacacacaaaggggggagtcagtctcagtcaggacacagcatggacatgagggtccccgctcagctccgtggggctcctgctactcgtggctccgaggtgccagatgtgacatccagatacgacccagtcctaccattccttccctgtcgtgccatgtaggtaggacgacagacctacacatcgacgttcggaccgganagaaccagaactagtggacagtacttaatttaagtaggttacncgtaacgacgaaacggaaaccgaacggggaaaccctaccccgtaaccctactacgtactcgtancgtacgtacgacgtactaccttacgtacgaacggtaacggtacggtaaccgtacccgaaggttcgggtaacggttacgaggttagggtaccggtagggttcggggttacgtacgggtaacttacgttaccgtttaccttcccgttacgttaccccgaaacttacggtacgtaccttacgtccgtacgtaaccgttaaccgtaattaacgtttctttaaccgggtacctttaaccgttaaccgtttacgtaaccgttaacgtaaaccggttagtttaaacctttaaacccgtgtttaccccgtaacccttaacgtttaccccgggtaacgttacccgggaaaccggtaaccggaccggtaaaccggttacggtaaaccgggtaaattaaacggtaaaccggttacgtaggtaaccgccggtaacctaaccgg

SEQ ID NO: 71204 - DNA, 751 bp, Homo sapiens
  misc_feature: GYAE6OF01AN4BX.51.32.C10.1.454.CMB.1.raw
  modified_base (376)..(376): a, c, t, g, unknown or other
  misc_feature (376)..(376): n is a, c, g, or t
tcagcgatcgtatacacgaccggtgctcgatttagtatagacatcaacacacaaagggggagtcagtctcagtcaggacacagcatggacatggagggtccccgctcagctccgtggggctcctgctactctggctccgaggtgccagatgtgacatccagatcgacccagtcctccattccttccctgtctgctatcgtaggtaaggagaacgagacgtaccaccatcctacgttcgggaccgggacaaacgaacgaaggaaactagttacggctaacgtactttaagtttaaagttggtaatacagaccgaaacgaaaccgaacgggaaacccgtacccctaaccgtaccgtagtacttacgtatcgctcgacnccgtaccgtacttagaacgaagtacggtaccgtacgtacggtaacgtacggttacgaggtacggtaggtacgggttcggggtacgtacgggaactacggttctttcgtaccctctaacccgttagtaacggttactcggtaactacgtaccggaaacctttaaccggaagtttaacgttacgttttaacggaaccctttaaacgttaacttaccgtaagtaaacccgtaagttacgttaaacgttaacgttaacttaccgaacctttaccgttaacccgttacggttcccggaaaacgtccggtaactaccgggtaaactaagggtaaactaaacggtaaccggttagttaccgggacgtacccgtaggtacccc

SEQ ID NO: 71205 - DNA, 774 bp, Homo sapiens
  misc_feature: GYAE6OF01B2ZQM.51.32.C10.1.454.CMB.1.raw
  modified_base (201)..(201): a, c, t, g, unknown or other
  misc_feature (201)..(201): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (761)..(761): a, c, t, g, unknown or other
  misc_feature (761)..(761): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttcctgtctcgcatcgtgtagganacagagtcaccatctacttcggaccgggacaagacgaagaacctagttggacagtattaatttaaagttgggtatacgagtacaaaggaaaccgtaagggaaccacccccttaacctccgtanactaccttaatctacgngactacgtacctacgtttacgaacctaaaggtggtaaccgttcccaaacgttcggtaaggttccgagttacgggcgtacggttgggtaaccggtggggtaactacggttacctttccgtaccgttaccgtaacctacccggtaattaacggtcccgttaaggtttccgtacgtaacccgttaacgttaacccggtaaaggttttaccttttaggaccctttaaaaccgttttaccgttaacggttaacccgttactaaacccgggttagttaaaccggtttaacttaaaccgttttccggaacccctttaaggttccccgtttaaaccgtttacccggggtaaaccgggtaacggtaaacccggtacggtaacgttacggggaaattaaaccgtttaaacggtaaccgtagggttaccgngttacggaacccc

SEQ ID NO: 71206 - DNA, 836 bp, Homo sapiens
  misc_feature: GYAE6OF01DW6OS.51.32.C10.1.454.CMB.1.raw
  modified_base (582)..(582): a, c, t, g, unknown or other
  misc_feature (582)..(582): n is a, c, g, or t
tcagcgatcgtatacacgaccggtgctcgatttagtatagacatcaacacacaaagggggagtcagtctcagtcaggacacagcatggacatggacgggtccccgctcagcctccgtggggctccgtgctactctcggcctccggaggtgaccaggatgtagacactccgagaatccgaccagtcctacctatccttcccgtgtctcgactagtcgtaggtaacgggacaacgacgaacgtccaaccactagtaccgtcggaccggacaaacgaacgtaagaactaggttcgactagtaactttaaagtttaacttaggtaactacggaacaaccggaaaaggtaaaacccgggaaaccggtaaaaccggtaaccccccgttaaaacctccgttaagtaacctgtaacgttcgccgtacggacctacggtaccctacgttaacgaaccggtaaacggtcggtaacctacccgtaagtaccgggtttacgtaaccggtaggtggacgtaagggcgggttacggaggtaacccgttgtaccggtttacctttaccgaaccgttactaaccgtaacgttaaccgngttacgtaacgtcctaaccgttaaacgtacgtaacgtttattaaccggtacctttaaacgttaccttaacgttagaaacccttaacgtaaggtttaaacccttaagttaaccgtttccccgaacttaccgtaaccgttccccggttaacgggaaacccgggtaaaggttaccccctaacgggtaacggtttaacgaaaacgtttaaaaccgtaaacggacgggtttgaaaccccggttaagtcgtaaacccccg

SEQ ID NO: 71207 - DNA, 834 bp, Homo sapiens
  misc_feature: GYAE6OF01ELDPL.51.32.C10.1.454.CMB.1.raw
tcagcgatcgtatacacgaccggtgctcgatttagtatagacatcaacacacaaagggggagtcagtctcagtcaggacacagcatggacatgacgggtccccgctcagctccgtggggcctctgctactctggctccggaggtgccagatgtgacatccagatcgacccagtcctcctatccgttccctgtctcgctatcgtaggtaaggacgtagagtactacgacctataccgtacgttacggcccgggaactaaggaccgaagtaaacctggtcgacgtagtacttaagtttaatcggtatacgagtaacgaaccggtaaaaccggtaaggaacccgtaccccccttaaaccttccgttaacgaactttacctaaggttccgtccagtacccgtacgtaccttacgttcgaacgtaacgttaccggtacgtccgtagtacggtaacggtttcctggtacgtacgggaacggttcggggtactggggtaaacttcggttaacgttttcgtacctaaccgttacctaacgttacgtacgtaccgttacgggtacccttacggtaaacccgttaccgttagggtttaacccggtttattttaacccccgtacttaaaccgttttaaccctttacccgggttaaacgttacccggaaacgtttaacgttaaaccgttttaacggtaaccgtttacccgtaactacccggttaaccggttacccggtttaaaccgggaaaccggtaaccggtttaccggaaaccggtcgttaaaccggttaacccttaaagggtaacccgtacgttacgggtcttaaacccgggctaaaccccgg

SEQ ID NO: 71208 - DNA, 890 bp, Homo sapiens
  misc_feature: GYAE6OF01BA74L.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagcctcctggggctcctgctactctggctccgaggtgccgagatgtgacactccagatcgaccctagtcctccacttccttccctgtctcgactacttcgtaggtaaggacgacaggtaacgtaccaaccctattaccgtaccgttaccgggacccggggactaacggaaccgaaacgtaacctaagggttcggaacctaacggttaccttttaaaagtttttaaacggttaggttaacctacgaaacggtaaccgaaaaccgggaaaaccccggtaaaccgggggtaaaccccttaccccccttaaccgttaccggttaggtaccttaacgtacgttacggtactacgaacctcccgttaacctttacggttaaccgaggtaaacgggtcccggttaaccgtcccggtaaggttaccgggtaacgggtttacgtcggtaccgggtacggttacggggtttacggttaccggtaacggggtaacttacgtttaccgttttcccgttactaccccttaacgttacccgttaaggttaaccgtcgttaaccggttaccgtacccgttaaacggtaaccgtttaacgttaacggtttaactttacgtaacccgttttaacttaaccgttacgttaccgtaacgtaaacgttacgttaaccggtttaaactacggttaccccaagtttacctaccggttaacccggtaccggtaaacggaacgttaaccgacgggtacgtaagtaaccgttaaacggtacggtacgttaggtcgtacctccggtaacc

SEQ ID NO: 71209 - DNA, 726 bp, Homo sapiens
  misc_feature: GYAE6OF01D9F6B.51.32.C10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtatagacatcaacacacaaagggggagtcagtctcagtcaggacacagcatggacatgaggtccccgctcagctcctgggctcctgctactctggctccgaggtcgccagatgtgacatccagatcgacccagtctccatccttccctgtctgcatctgtagganacagagtcaccatcactggccggacaagacagaacagttggcagtcttaatttaaatggtatcagacaacgaaaccgagggaaaccgcccctaaccgtccgtagactactatgacctgacacgcctacgtttacggacgtaaaggtcggtaaccgtccctaagttcggtaacggttcaggttcggacgtagggtcgggtacgtcggggaactacggtatttcctaccgttctaccaccgttagttacgactaacggttctacggtacctaaccgttagtaagtttacgttttacgaaccttaaacgtttaccgtaaccgttactaacggtaaaccgttaacggtttaaacgtttaacgttaacgttttcccggtaacccctaacgtttaaccgttaaccccggggtttaccggaaaccccggtaaaaggggtaccccttaaccgggtaaacgttaacgggtaaaacgttaaaaccgtttaaaaccgggtaccgttaggggtaaaccggttccgtaccggtaaaccc

SEQ ID NO: 71210 - DNA, 813 bp, Homo sapiens
  misc_feature: GYAE6OF01ESKN3.51.32.C10.1.454.CMB.1.raw
  modified_base (141)..(141): a, c, t, g, unknown or other
  misc_feature (141)..(141): n is a, c, g, or t
  modified_base (200)..(200): a, c, t, g, unknown or other
  misc_feature (200)..(200): n is a, c, g, or t
  modified_base (232)..(232): a, c, t, g, unknown or other
  misc_feature (232)..(232): n is a, c, g, or t
  modified_base (360)..(360): a, c, t, g, unknown or other
  misc_feature (360)..(360): n is a, c, g, or t
tcagcgatcgtatacacgaccggtgctcgatttagtatagacatcaacacacaaagggggagtcagtctcagtcaggacacagcatggacatggacgggtccccgctcagctcgtgggctcctgctactctggctcgagtncagatgtgacatccagatcgaccctagtcctcattccttccctgtctgcatctgtaggnacagacgtccactatccagttcggaccggganaacgactaggaacctgttacgggcaagtcttaaatttaacgttggtaactcgaacgtaccgaaacgtaaacccggagggtaaaaccctcccccttaaaccgtcccgtagtaacttctaacgtcggtcnggtacaccgtaaccttacggtttcgaaacgttaaggtcggtaaacctcccgtaaaggtccgggtaacgtttacgacgggtcgtacggtaacggtttcggggtaccgtaacgggtaactaaccggtttacgttttcccgtaccttaccgttaacccgtaaccggttaacgtaacgtacgttaccggttaccgtaccgttaaccttaaacccgttaggttaaacgtttctttttaaccggaccttaaaccggttttaacctacggttaacccttacgttaaaacccgtaacgtttaaaccgtttaacgttaaccctttacccggaacccgttattaaccccgttaccgttaacccgggaaaccgtaaaccgggttaaccgtaacggtaacgttaccggggtaattaaaaaccggtaaccggtacgtttaaggtcccggtaaactccggtaaaccc

SEQ ID NO: 71211 - DNA, 485 bp, Homo sapiens
  misc_feature: GYAE6OF02INQSU.51.32.C10.1.454.CMB.1.raw
tcagcgatcgtatacacgaccggtgctcgatttagtatagacatcaacacacaaaggggagtcagtctcagtcaggacacagcatggacatgagggtccccgctcagctcctgggctcctgctactctggctccgaggtgccagatgtgacgatcccaggatgaccagtcgtccagtcttaccgtgtctagcatctgtaggagacagagtcaccatcacttgccgggcaagacagaacattggcagctatttaaattggtatcagcagaaaccagggaaagcccctaactcctgatctatgctgcagccactttgcaaagtgagtccatcgagttcagtgcagtgggtctgggacagatttctctctcaccattagcagtctgcaacctgaagattttgcaacttactactgtcaacagagttacaatttgcccatcactttcggcaagggacacgactggagattaacgaactgtggactgacc

SEQ ID NO: 71212 - DNA, 531 bp, Homo sapiens
  misc_feature: GYAE6OF02HINOS.51.32.C10.1.454.CMB.1.raw
tcagcgatcgtatacacgaccggtgctcgatttagtatagacatcaacacacaaaggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaagcccctaacctcctgatctatgctgcagccactttgcaaagtggagtcccatcgaggttcagtgcagtgggtctgggacagatttctctctcaccattagcagtctgcaacctgaagtattttgctaaactttactactgtacaaactagtagtttaacaaatttcgaccctattccacgttttcggaccctaaaggggtacttaccggaacttggaagtaactttaaacggaaaccttggtacggtactgaacccg

SEQ ID NO: 71213 - DNA, 489 bp, Homo sapiens
  misc_feature: GYAE6OF02FIWRZ.51.32.C10.1.454.CMB.1.raw
  modified_base (277)..(277): a, c, t, g, unknown or other
  misc_feature (277)..(277): n is a, c, g, or t
  modified_base (364)..(364): a, c, t, g, unknown or other
  misc_feature (364)..(364): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaancccctaacctcctgatctatgctgcagccactttgcaaagtggagtcccatcgaggttcagtggcagtgggtctgggacagatttcnctctcaccattagcagtctgcaacctgaagtattttgctaactttactactgtcaacagagtttacaatttgccctatcctactttcggccaagggacacgactggagattaacgactgtgctgc

SEQ ID NO: 71214 - DNA, 507 bp, Homo sapiens
  misc_feature: GYAE6OF02GV4FX.51.32.C10.1.454.CMB.1.raw
  modified_base (480)..(480): a, c, t, g, unknown or other
  misc_feature (480)..(480): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaagcccctaactcctgatctatgctgcagccatttgcaaagtgagtcccatcgaggttcagtggcagtgggtctgggacagatttctctctcaccattagctagtctgcaacctgaagattttgactaaacttactactgtacaaacagtaacgttacaatttacgccctatctactttcggacctaaagggtacacgacctaggaanaagttaaacgaactggtacggctgacc

SEQ ID NO: 71215 - DNA, 512 bp, Homo sapiens
  misc_feature: GYAE6OF02J1M6Y.51.32.C10.1.454.CMB.1.raw
  modified_base (398)..(398): a, c, t, g, unknown or other
  misc_feature (398)..(398): n is a, c, g, or t
tcagcgatcgtatacacgaccggtgctcgatttagtatagacatcaacacacaaaggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacgcccctaactcctagatctatgctgcagccacttgacaaagtggatcccatcgaggttcagtggcagtgggtctgggacaggatttcgtctctcacctattagcagtctgctaacctgaagtntttgctaacttactactgtcaactagtagttaacaatttcgacctatctacttcggaccaagggaccacgtacgtaggaagtaacgttaaccgaacttggtacggtcttagacc

SEQ ID NO: 71216 - DNA, 484 bp, Homo sapiens
  misc_feature: GYAE6OF02GOV89.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaacctcctgatctatgctgcagccactttgcaaagtggagtcccatcgaggttcagtggcagtgggtctgggacagatttctctctcaccattagcagtctgcaacctgaagtattttgctaacttactactgtacaacagagttacaatttgccatcacttcgccaaggacacgactggagattaacgactgtagctgacc

SEQ ID NO: 71217 - DNA, 532 bp, Homo sapiens
  misc_feature: GYAE6OF02H135E.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaactcctgatctatgctgcagccactttgcaaagtggagtccatcgaggttcagtgcagtgggtctgggacagtatttctctctcacattagcagtctgcaacctgaatattttgactaacttactactgtacaactagtaagttacaatttcgaccctattacctaccgttttacggaccctaaaggggaccaacggtaacgttaggaacgtaacgttaaaccgaacgttaggtacggtctagtacccg

SEQ ID NO: 71218 - DNA, 527 bp, Homo sapiens
  misc_feature: GYAE6OF02IKMT6.51.32.C10.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggnaagacagaacattggcagctatttaaattggtatcagcagaaaccagggaaacncccctaactcctgatctatgctgcagccatttgacaaagtggactcccatcgaggttcagtgcagtgggtctgggacagtatttctctctcactattagcagtctgcaacctgaagtatttgactaacttactactgtacaactagagttacaatttcgaccctatcctacgtttccggaccgtaaagggtaccacggtaacgtaggaacgtaacgttaaacggtaaccgttaggtacggtacgtgacc

SEQ ID NO: 71219 - DNA, 754 bp, Homo sapiens
  misc_feature: GYAE6OF02HPV1O.51.32.C10.1.454.CMB.1.raw
  modified_base (237)..(237): a, c, t, g, unknown or other
  misc_feature (237)..(237): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtcctgctatctggtaggacgacgagtacgtccacctatcctacgtcggccgganaacgacgaacgaactagtcgacgacgtactttaaattttaagttaggtactacgacgacgaaaaccgaaaccggaagggaaaccccgtaccccttaacccgtcgtacgtacttactagtcgtacctcgacgacgtacccttacgtttacgaacgtaaaggtcggtaacccgtaccctaaggtacggttacggttacgtacgggtcggtacgtaggggttcgggttacggtacgggtaacgtaaggttttactttccgttaccgttcctacccgtaactttaggttaacgaccgtacggttctacggaacccttaaccgttaaggaaacgttttcgttttacgaacctttaaacctttacgttaccgttacgtaacccaaagtacgtttaacgttaactttaacgtttccgaacccttactaccgtttaccggttccgaaccggtaaacggtaccgtacgtaacgtacggtaattaaccgttaaaccgcggttacggtacggtaccgtacgtaacccg

SEQ ID NO: 71220 - DNA, 550 bp, Homo sapiens
  misc_feature: GYAE6OF02F6JZP.51.32.C10.1.454.CMB.1.raw
  modified_base (278)..(278): a, c, t, g, unknown or other
  misc_feature (278)..(278): n is a, c, g, or t
  modified_base (399)..(399): a, c, t, g, unknown or other
  misc_feature (399)..(399): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacncccctaacctcctgatctatgctgcagccactttgcaaagtggagtcccatcgaggttcagtggcagtgggtctgggacagtatttctctctcaccattagctagtctgacaactgaagtnttttagctaactttactactgtacaactagtagtttaacaatttcgaccctattcctaccgttttcggacccgtaaaggggtacctaacggtaaccttagggaacgtaacgtttaaaaccggaaccgttaggttacgggtacttaggaccc

SEQ ID NO: 71221 - DNA, 515 bp, Homo sapiens
  misc_feature: GYAE6OF02IHYUP.51.32.C10.1.454.CMB.1.raw
  modified_base (273)..(273): a, c, t, g, unknown or other
  misc_feature (273)..(273): n is a, c, g, or t
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
  modified_base (483)..(483): a, c, t, g, unknown or other
  misc_feature (483)..(483): n is a, c, g, or t
tcagcgatcgtatacacgaccggtgctcgatttagtatagacatcaacacacaaaggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacatggcagctatttaatgtatcagcagaaaccagggaaacncccctaactcctagatctatgctgcagccattgcaaagtgactccatcgagtcagtgcagtgggtctgggacagatttctctctcaccattagnacgtctgacaaccttggaaactagttttnctaaacctttatactgttacaaacagtacgtttaacaaagtttgccctaatcctactttcggaaccgaagggacacgtaatcggaanaactttaaaaccgattaggtcggactgaaccg

SEQ ID NO: 71222 - DNA, 501 bp, Homo sapiens
  misc_feature: GYAE6OF02FVYC3.51.32.C10.1.454.CMB.1.raw
  modified_base (278)..(278): a, c, t, g, unknown or other
  misc_feature (278)..(278): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacncccctaacctcctgatctatgctgcagccactttgacaaagtggagtcccatcgaggttcagtgcagtgggtctgggacagtatttctctctcacctattagctagtctgacaacctgtaagtatttgactaacttactactgtacaacagtagttacaatttcgacctatctactttcggacctaagggaccacgactggagattaacgactgtcgctgacc

SEQ ID NO: 71223 - DNA, 509 bp, Homo sapiens
  misc_feature: GYAE6OF02JFR5H.51.32.C10.1.454.CMB.1.raw
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
tcagcgatcgtatacacgaccggtgctcgatttagtatagacatcaacacacaaaggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctattaaatggatcagcagaaaccagggaaancccctaacnctgatctatgctgcagccacttgcaaagtggatccatcgagttcagtgcagtgggctgggacagatttcnctntcacctattagcagtctgcaacgtgaagtatttgctaacttactactagtacaaacagtacgttaacaagttttacgccctaatcctactttcgacccgtaaggaactacgacgttaggaagtacttaaacgaaccttggtacggcttagaccg

SEQ ID NO: 71224 - DNA, 521 bp, Homo sapiens
  misc_feature: GYAE6OF02JB5BB.51.32.C10.1.454.CMB.1.raw
  modified_base (278)..(278): a, c, t, g, unknown or other
  misc_feature (278)..(278): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacncccctaactcctgatctatgctgcagcctactttgacaaagtggagtcccatcgaggttcagtggcaggtgggtctgggacagtatttctctctcactattacgctagtctgccaactagaagtatttgacctaacttactacttcgtacaactagtaagttactaatttcgaccctattcctacgtttcggaccgtaagggaccacgactaggaagtaacttaaacgactggtaggctgacc

SEQ ID NO: 71225 - DNA, 611 bp, Homo sapiens
  misc_feature: GYAE6OF02JZVLJ.51.32.C10.1.454.CMB.1.raw
  modified_base (277)..(277): a, c, t, g, unknown or other
  misc_feature (277)..(277): n is a, c, g, or t
  modified_base (296)..(296): a, c, t, g, unknown or other
  misc_feature (296)..(296): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaatggtatcagcaagaaaccagggaaacncccctaactccagatctangctgcagccatttgacaaagtcggagtcccagtcgagttcagtggactaggttgggtactgggactaggtacgtttctcctcttacgaacctagtttacgacttaggtcctcggacctaaaccgttagaacgttacttttacgacttaaactttcgaacttgtaacctaaacgtggttaactttaaccgaagttttcgaacccctattccgtacccgttttccggtaacccgaaacgggtaccctaaacgggtccgttaacgggtaactaacgtttaaaacccggagttcgggtacggttaccgtacgtaacccg

SEQ ID NO: 71226 - DNA, 506 bp, Homo sapiens
  misc_feature: GYAE6OF02FKTZG.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaacctcctgatctatgctgcagccatttgcaaagtggagtcccatcgaggttcagtgcagtgggtctgggacagatttctctctcacattagctagtctgcaacctgaagtattttgctaacttactactgtacaacagagttaacaatttcgaccctatcctactttcggaccgtaagggaccacgacgtaggaacgtattaaacggaactggtcggctgacc

SEQ ID NO: 71227 - DNA, 505 bp, Homo sapiens
  misc_feature: GYAE6OF02G8G5G.51.32.C10.1.454.CMB.1.raw
  modified_base (424)..(424): a, c, t, g, unknown or other
  misc_feature (424)..(424): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcaagaaaccagggaaacgcccctaacctcctgatctatgctgcagccactttgcaaagtggagtccatcgagttcagtggcaggtgggtctgggacagtatttctctctcacctattagcagtctgctaacctgaatatttgactaacttactactgtacaanagtattacaatttcgccctatcctactttcggaccgaagggaccacggactggaagtaacgttaacgatggtaggctgacc

SEQ ID NO: 71228 - DNA, 519 bp, Homo sapiens
  misc_feature: GYAE6OF02GY8MM.51.32.C10.1.454.CMB.1.raw
  modified_base (510)..(510): a, c, t, g, unknown or other
  misc_feature (510)..(510): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtagagacagagtcaccatcacttgccgggcaagacagaacattggcagctatttaaattggtatcagcagaaaccagggaaacgcccctaacctcctgatctatgctgcagccactttgcaaagtggacgtcccatcgaggttcaggtgctaggtgggtctgggactagtatttctctctccacctattacgctagttcctgtacctaacgtgtaagtattttcgactaactttactactagtccaaactagtattactaattcgacctatcctacgttcgaccgtaaggacacgactggataacgtaacgacgtgngtactgacc

SEQ ID NO: 71229 - DNA, 493 bp, Homo sapiens
  misc_feature: GYAE6OF02IDDMD.51.32.C10.1.454.CMB.1.raw
  modified_base (257)..(257): a, c, t, g, unknown or other
  misc_feature (257)..(257): n is a, c, g, or t
  modified_base (434)..(434): a, c, t, g, unknown or other
  misc_feature (434)..(434): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaatggtatnagcagaaaccagggaaacgcccctaacctcctgatctatgctgcagcctactttgcaaagtggatcccatcgagttcaggtgcagtgggtctgggacagtatttctctctcacattagcagtctgccaactgaatatttgactaacttactactgtacaacagtagttaactaattnaccctatctactttccggacgaaggacacgactgagaattaacggactggtgtctgacc

SEQ ID NO: 71230 - DNA, 530 bp, Homo sapiens
  misc_feature: GYAE6OF02G2ZAL.51.32.C10.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (394)..(394): a, c, t, g, unknown or other
  misc_feature (394)..(394): n is a, c, g, or t
  modified_base (419)..(419): a, c, t, g, unknown or other
  misc_feature (419)..(419): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggnaagacagaacattggcagctatttaaatggtatcagcaagaaaccagggaaacncccctaacctcctgatctatgctgcagccacttgcaaagtgagtccatcgagttcagtgcaggtggtctgggacagtactttctctctcactattagctagtctgcaacctgaatntttgactaacttactactgtacaanagtaagttactaactttcgaccctattacctacttacggaccgtaaacgggactaccgtaacgtaggaactaacgttaaaccggaacgttggtacggtacctaggtaaccc

SEQ ID NO: 71231 - DNA, 602 bp, Homo sapiens
  misc_feature: GYAE6OF02G0VB7.51.32.C10.1.454.CMB.1.raw
  modified_base (282)..(282): a, c, t, g, unknown or other
  misc_feature (282)..(282): n is a, c, g, or t
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcctccatcttccctgtctgcatctgtaggagacagagtcaccatcacttgccgggcaagacagaacattggcagcttaatttaaatggtatcagcaagaaaccgagggaaacnccccctaacctcctgactctatgctgcagtcctaacgtttgacgtaaaggtcggacgtcccagttcggaggttcaggtggcagggttgggtctgggacaggtctttctctctcaacctattacgctagttcngacctaaccgtgaaagttntttacgacttaaccttactactgttacaacgtagtaacgttaactaagtttcgaccctattacccgtacgtttaccggaaccgtaaacggggtacctaaccgggtacgttacgggtaaacgttaaacgtttaaaccggaaccgtttgggtacggttaccgtagaacccg

SEQ ID NO: 71232 - DNA, 651 bp, Homo sapiens
  misc_feature: GYAE6OF02IJWJS.51.32.C10.1.454.CMB.1.raw
  modified_base (282)..(282): a, c, t, g, unknown or other
  misc_feature (282)..(282): n is a, c, g, or t
  modified_base (472)..(472): a, c, t, g, unknown or other
  misc_feature (472)..(472): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggacaagacagaacattggcagcttaatttaaatggtatcagcaagaaaccgagggaaacncccctaaactcctagatctaatcgctgccagcctattagacaaagtcggaacgtcccagttcggagttcaggtggcgtaggtcgggtacgtaggggaactaggttacttttcctacctcgtacccaaccgttaagtttacgaccgttaggtcccttagggaacccttaaaacccgttggtaaaacgtttnttttacgaccttaaaccctttaacgtaccgttacgttacctaaaacgtgttaaacgtttaaccttaagtttaccgacccttaaattcccgttaccgtttacggaacccgtaaagggtacctaaccggtacgtaaggtacgtaacgttaaaccggtattcgggtaacgccttaggaaccc

SEQ ID NO: 71233 - DNA, 493 bp, Homo sapiens
  misc_feature: GYAE6OF02IOGCD.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaactcctgatctatgctgcagccactttgcaaagtgagtcccatcgaggttcagtggcagtgggtctgggacagatttctctctcaccattagcagtctgcaacctgaagtattttgactaacttactactgtcaacagagttacaatttgcccattcactttcggaccgtaagggaccacgactggagattaacgaactgtggctgaccg

SEQ ID NO: 71234 - DNA, 501 bp, Homo sapiens
  misc_feature: GYAE6OF02GCKMW.51.32.C10.1.454.CMB.1.raw
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaagcccctaacctcctgatctatgctgcagccactttgacaagtggagtcccatcgagttcagtgcagtgggtctgggacagatttcnctctcaccattagctagtcngcaacctgaagtatttgctaacttactactgtacaacagtagttaacaatttcgacctatctactttcggacctaagggaccacgactggatagttaaacgacttggtacggtactgac

SEQ ID NO: 71235 - DNA, 610 bp, Homo sapiens
  misc_feature: GYAE6OF02JU72B.51.32.C10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttcctgtctgcatctgtagganacagagtcaccatcacttgccgggcaagacagaacattggcagctaatttaaattggtatcagcaagaaaccgagggaaacgcccctaaacctcctagactctatgtctgccacgtcctactttcgacaaagtcggacgtccatcgaggttcagtggctaggtgggtcgtagggacagtacttctactctacacctattacgctagttctagacctaacgtagtaagttctttacgacctaaaccgtttactacttacgtacgtaaacctaggtaacgtttaactaaagtttccgacccgtaattaccgttacgtttccgggtaaccgtaaacggggttaaccacgggtaaccgttacgggtaacgttaaacgttaaaccggaacgttggtaccgggttactacgtaacccg

SEQ ID NO: 71236 - DNA, 743 bp, Homo sapiens
  misc_feature: GYAE6OF02J0FM2.51.32.C10.1.454.CMB.1.raw
  modified_base (149)..(149): a, c, t, g, unknown or other
  misc_feature (149)..(149): n is a, c, g, or t
  modified_base (310)..(310): a, c, t, g, unknown or other
  misc_feature (310)..(310): n is a, c, g, or t
  modified_base (593)..(593): a, c, t, g, unknown or other
  misc_feature (593)..(593): n is a, c, g, or t
tcagcgatcgtatacacgaccggtgctcgatttagtatagacatcaacacacaaaggggagtacgagtctcagtcaggacacagcatggacatgaggtcccgctcagctcctggggctcctgctactctggctccgaggtgccagatgngactactccagatcgacccagtctccatccttccctgtacctgctattcctgtagagactagactcaccatccactttcggccgggacaaggacaagaaccagttcggactagcttaatttaaagtggtaatcgagacaacgaaaacccgaggggaaaccncccccttaaaccgtaccgtaggtacttaccgtaagtccggtctacggcctacgtaccctacttttagaaccgtaaaggtcggtaacgttccccaagtaccgggttaacggttcctaagggtccgtacggtacggttcggggtttacacgggggtactaggttacttttccggcctttacctcggaacccttagttacgtccgtacgtcttccgaccttaaccgttgtaaacggttcgttttacgaccgttaaaccttacttaacgttcgtacctaaaaccgtntttacgaaactttactttcccggaacccttaattccccgtagtttacccgggtacccgaaaaggggtaccccctaagggtaccccgttaagggtaataacccgggttttaaaacccgacgtttacgggttacggaccgtttccgaaaccc

SEQ ID NO: 71237 - DNA, 543 bp, Homo sapiens
  misc_feature: GYAE6OF02F4Y4V.51.32.C10.1.454.CMB.1.raw
  modified_base (278)..(278): a, c, t, g, unknown or other
  misc_feature (278)..(278): n is a, c, g, or t
  modified_base (405)..(405): a, c, t, g, unknown or other
  misc_feature (405)..(405): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacncccctaacctcctgatctatgctgcagcctatttgacaaaggtggactcccagtcgagttcagtggcaggtgggtctgggacagtatttctctctcacctattagctagtctgaccaacctgaagtnttttagactaacttactaccgtactaactaacgtagttaacttaacttacttcctacctactaccttaccggtaccgaacggaacgaaccgtacgtacgtagtaagtaacgtaacgtacgtaggtcgtacgcgtaacc

SEQ ID NO: 71238 - DNA, 523 bp, Homo sapiens
  misc_feature: GYAE6OF02H8MVI.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctaatttaaattggtatcagcaagaaaccagggaaacgcccctaaacctcctgatctatgctgcagccactttgcaaagtggatcccatcgagttcagtggcaggtgggtctgggacagtatttctctctcacctattagcagtctgacaacctgaagtattttgactaacttactactagtacaacagtagtttaacaatttcgaccctatcctacgtttcggaccgaagggaaccacggtaacgtggaagtaacttaaacgaattggtcggtctagacc

SEQ ID NO: 71239 - DNA, 519 bp, Homo sapiens
  misc_feature: GYAE6OF02IDY5P.51.32.C10.1.454.CMB.1.raw
  modified_base (276)..(276): a, c, t, g, unknown or other
  misc_feature (276)..(276): n is a, c, g, or t
  modified_base (353)..(353): a, c, t, g, unknown or other
  misc_feature (353)..(353): n is a, c, g, or t
  modified_base (393)..(393): a, c, t, g, unknown or other
  misc_feature (393)..(393): n is a, c, g, or t
tcagcgatcgtatacacgaccggtgctcgatttagtatagacatcaacacacaaagggggagtcagtctcagtcaggacacagcatggacatgagggtccccgctcagctcctggggctcctactactctggctccgaggtgccagatgtgacatccagatgacccagtctccatcttccctgtctgcatctgtaggagacagagtcaccatcacttgccgggcaagacagaacattggcagctatttaaattggtatcagcagaaaccaggaacncccctaacctcctgatctatgctgcagccactttgacaaagtgacgtccatcgagttcagtggcagtggtctggacngtatttctctctcaccattagctagtctgcaacctgaatntttgactaacttactactgtacacagtagttacaatttcgaccctatacctactttaccggaccgtaacgggcctaacgacgtaggtaagtaattaaacggacttaggtacggactcgactaaccg

SEQ ID NO: 71240 - DNA, 522 bp, Homo sapiens
  misc_feature: GYAE6OF02FMP8R.51.32.C10.1.454.CMB.1.raw
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
  modified_base (367)..(367): a, c, t, g, unknown or other
  misc_feature (367)..(367): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacntggcagctatttaaatggtatcagcagaaccagggaacncccctaactcctgactctatgctgcagcctatttgacaaagtggacgtcccagtcgaggttcaggtgctaggtgggtctgggacagtatttcnctctcacctattacgctagtctagcctaacgtgtaagttattttgactaacttactactagtaccaaatagtagtttacaatttcgacctatctacgttcggacgaagggtaccaacggtctaggaataacgttaacgagttgtcggctagtacc

SEQ ID NO: 71241 - DNA, 541 bp, Homo sapiens
  misc_feature: GYAE6OF02GRLAX.51.32.C10.1.454.CMB.1.raw
  modified_base (301)..(301): a, c, t, g, unknown or other
  misc_feature (301)..(301): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagcttaatttaaatggtatcagcaagaaaccgagggaaacgcccctaacctcctgatctangctgcagcctatttgacaaagtggactcccatcgaggttcaggtggcaggtgggtctgggacagtatttctctctacacctattagctagtctgcctaactgaattatttgactaacttactactgtacaacgtataacgttacaagtttcaccctattcctacgtttcggaccgtaaggacctacgtaacgtaggtaacgtaacgttaaaccggacgttacggtaggtcctaggtaccc

SEQ ID NO: 71242 - DNA, 562 bp, Homo sapiens
  misc_feature: GYAE6OF02FUEBZ.51.32.C10.1.454.CMB.1.raw
  modified_base (346)..(346): a, c, t, g, unknown or other
  misc_feature (346)..(346): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctaatttaaattggtatcagcaagaaaccagggaaacgcccctaacctcctgatctatgctgcagccactttgcaaagtggagtcccatcgaggttcagtggcnggtgggtctggggacagtatttcgtctctcacctattacgctagtctgactaaccgtgtaagttattttgactaacttctactacgtctaacaagtagttaacgttaattacgttccaccttacttaccgttacgttccggaacggtaacggaccgtaaccgtacggtaaggtaacgtaacggttaaaccgtacggttacggtacggtactaccgg

SEQ ID NO: 71243 - DNA, 547 bp, Homo sapiens
  misc_feature: GYAE6OF02FQS3F.51.32.C10.1.454.CMB.1.raw
  modified_base (369)..(369): a, c, t, g, unknown or other
  misc_feature (369)..(369): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagcagaacattggcagctatttaaattggtatcagcagaaaccagggaaacgcccctaaactcctgatctatgctgcagccactttgacctaaagtggacgtccatcgagttcagtggcaggtgggtctgggacagtactttcnctctctactattagctagtctgcaacctgaacttatttgactaattactactagtcaactagtacgttactaatttcgccctattcctacgtttccggaaccgtaagggtaccaccgggtaactaggtaaccgtaagtttaaaccggtaacgttagggtacggacttcggtaaccccg

SEQ ID NO: 71244 - DNA, 572 bp, Homo sapiens
  misc_feature: GYAE6OF02H3RP6.51.32.C10.1.454.CMB.1.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (426)..(426): a, c, t, g, unknown or other
  misc_feature (426)..(426): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttcctgtctgcatctgtaggagacagagtcaccatcacttgccggnaagacagaacatgcagctaatttaatggtatcagcaagaaaccgagggaaacnccccctaacctcctagtactctatgctgcacgccctatttcgactaaaggtcggactcccagtcggtaggttcaggtcggctaggtcgggtcgtagggactagtatttctctctcacctattacgctagtctagacctaactgtaaattnttttacgacttaacctttactaacgtacgtaacaaacgtagtacgtttaactaatttcgaccctattcctaccgtttccggaccgaacgggtaccacggtacgtaggaacgttaacgttaaacggacttaggtcggtacttgaccc

SEQ ID NO: 71245 - DNA, 526 bp, Homo sapiens
  misc_feature: GYAE6OF02F22RM.51.32.C10.1.454.CMB.1.raw
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcaagaaaccagggaaacgcccctaactcctgactctatgctgcagcctatttgcaaaggtcggatcccagtcgaggttcagtggctaggtgggtctgggactgtattttcnctctcacattagctagtctgacaacctgaacttntttcgacttaacttactactgtacaactagtaactttaactaattcgacctattctactttcggaccgaagggaccacggtaactggaattaacgttaaacgacgttggacgacgtgtacc

SEQ ID NO: 71246 - DNA, 524 bp, Homo sapiens
  misc_feature: GYAE6OF02G1TVR.51.32.C10.1.454.CMB.1.raw
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccggnaagacagaacattggcagctaatttaaatggtatcagcagaaaccagggaaacncccctaactcctgatctatgctgcagccaattgacaaagtggatccatcgagtcagtgcagtggtcngggacagtatttcnctctacactattagctagtcngacaactgaagtntttcgactaacttacactgtacaacgtagtacgttacaagtttcgaccctatcctacgtttacggacctaaagggaccacggtagtacggaagtaaccgtttaaacgaacgttggttacggacctaggtacc

SEQ ID NO: 71247 - DNA, 595 bp, Homo sapiens
  misc_feature: GYAE6OF02F1Q9S.51.32.C10.1.454.CMB.1.raw
  modified_base (278)..(278): a, c, t, g, unknown or other
  misc_feature (278)..(278): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggacaagacagaacattggcagctaatttaatggtatcagcagaaaccagggaaacncccctaactcctgatctatgctgcacgcctactttgactaaagtcggacgtcccatcggaggttcaggtggcgaggttcgggtctaggggaactaggtactttctctctacacctattacgctagtcngactaacgtgtaattntttcgactaacgttactacgtagtacaaacgtagtacgttaactaacgtttcgaccctagttacccgttaccgtttaccgggacccgttaaacggggaacctaaccgggtaaccgttagggtaaactaacggttaaaaccggtacgttagggtacggtaccgtcggtaacccg

SEQ ID NO: 71248 - DNA, 606 bp, Homo sapiens
  misc_feature: GYAE6OF02HUVXQ.51.32.C10.1.454.CMB.1.raw
  modified_base (222)..(222): a, c, t, g, unknown or other
  misc_feature (222)..(222): n is a, c, g, or t
  modified_base (273)..(273): a, c, t, g, unknown or other
  misc_feature (273)..(273): n is a, c, g, or t
  modified_base (381)..(381): a, c, t, g, unknown or other
  misc_feature (381)..(381): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
tcagcgatcgtatacacgaccggtgctcgatttagtatagacatcaacacacaaaggggagtcagtctcagtcaggacacagcatggacatgagggtccccgctcagctcctggggctcctgctactctggctccgaggtgccagatgtgacatccagatgacccagtctccatcttcctgtctgcatctgtaggagacagagtcaccatcacttggccggnaagacagaacattggcagctaattaatgtatcagcagaaaccagggaaacncccctaactcctgactctatcgctgcagcctactttgactaaagtggacgttcccattcggaggttcaggttggactaggtcgggtcgtagggacctagtatttccgngttacctcgacctagttgctaagtctgtacctaaaccgtnaaacgttntttgactaacttatacctgttacaacgtagtaacgtttacaacgttttcacccgttaataccgtttaccgtttccgggaacccgttaagggtaaccctaacccgggttaattaacgggtaaaccgttaacgttaaaaacccggacgtttacgggttacgtaccggtttgaaaccccg

SEQ ID NO: 71249 - DNA, 527 bp, Homo sapiens
  misc_feature: GYAE6OF02FFTQT.51.32.C10.1.454.CMB.1.raw
  modified_base (278)..(278): a, c, t, g, unknown or other
  misc_feature (278)..(278): n is a, c, g, or t
  modified_base (369)..(369): a, c, t, g, unknown or other
  misc_feature (369)..(369): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctattttaaatggtatcagcagaaaccagggaaacncccctaacctcctgatctatgctgcagcctatttgacaaagtggacgtcccatcgaggttcagtggcaggtgggtctgggacagtatttcnctctcacctattacgctagtctgactaacctgtaagtattttgactaaccttactactgtacaaacgagtagtttaacaatttcgaccctatcctactttcggaccaaagggaccacggtacgtaggaagtaattaaacgacgtgtacggtctagacc

SEQ ID NO: 71250 - DNA, 537 bp, Homo sapiens
  misc_feature: GYAE6OF02HOQPQ.51.32.C10.1.454.CMB.1.raw
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (407)..(407): a, c, t, g, unknown or other
  misc_feature (407)..(407): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggnaagacagaacattggcagctatttaaattggtatcagcaagaaaccagggaaacncccctaacctcctgatctatgctgcagcctatttgacaaagtggatcccatcgaggttcagtggcaggtgggtctgggacagtatttctctctcacctattagctagtctgacctaaccttgaaagtnttttagctaaactttactacttagtaccaaacgagtagtttaacaatttcgaccctattcctaccgtttcggacccaaagggtaccaccgtagtacggtagtaacttaaacgacttggtcgactgtaccc

SEQ ID NO: 71251 - DNA, 601 bp, Homo sapiens
  misc_feature: GYAE6OF02GMW90.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaatgtatcagcagaaaccagggaacgcccctaactcctgatctatgctgcagcctactttgacaaagtggatccatcgagttcagtgcaggtggtcgtgggactagtatttcgtctctcacctattacgctagtctcgactaaccgtagtaacgttatttcgacttaaacgttacttacgttacgtaccaaacgtagttaacgtttaacgtaacttttccggacccttaattcccgtttaaccgttttccgggaaccgtaaacggggtaacctaaacccggtaacgttaacggggaacgttaaacgtttaaaaccggaaccggtttaggtacgggtaccttacggtaaccccg

SEQ ID NO: 71252 - DNA, 567 bp, Homo sapiens
  misc_feature: GYAE6OF02F4BL7.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacgcccctaactcctgatctatgctgcagccactttgacaaaggtggactccatcgaggttcaggtgctaggtcgggtcgtggggactaggtactttcctctctactaccctattacgctagtctacgacctaacctgaacgttattttcgaccttaacgtttacacgttcgtacctaaacgagttacgtttaactaactttcggacccctagttcctacgtttccgggaaccctaagggtaccacggtacgttaggaacgtaacttaaaccgacgttggtcggtactgtacc

SEQ ID NO: 71253 - DNA, 559 bp, Homo sapiens
  misc_feature: GYAE6OF02HMIDV.51.32.C10.1.454.CMB.1.raw
  modified_base (293)..(293): a, c, t, g, unknown or other
  misc_feature (293)..(293): n is a, c, g, or t
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcctccatccttccctgtctgcatctgtaggagacagagtcaccatcacttggccgggcaagacagaacagttggcagtcttaatttaaagttggtgtcaggacaagaaaaccgaagggaaaccncccccttaacctccgtagacttctatcgctgcacgcctactttgactaaagtcggacgtcccagtccggtaggttcaggttggcgtaggtgggtcgtagggactagtactttcncttctcactattacgctagtctagacctaactgaagttntttacgacttaacttactactagtacaatagtattaactattcgacctatctacgttcggaccgaagggaccacgtagtaggagtaacgttaacgagtggtacgtccagtacc

SEQ ID NO: 71254 - DNA, 648 bp, Homo sapiens
  misc_feature: GYAE6OF02G6U0N.51.32.C10.1.454.CMB.1.raw
  modified_base (199)..(199): a, c, t, g, unknown or other
  misc_feature (199)..(199): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtagganacagagtcaccatcacttgccggacaagacagaacattggcagcttatttaaatgtatcagacagaaaccagggaaacncccctaactcctgatctangctgcagcctacttgacaaagtggactccatcgagttcgagtggctaggtcgggtcgtaggggactagtactttctactctacctacctagttacgactacgttctacgtaccgaacccgttagtaaacgttattttacgaacttaaacctttacgtaccgttagtacctaaacctaggttaacgtttaacttaacgttttaccggaccccttaacgttacccgttacccgtttttacccggaacccggtaaacgggtaacccgaacgggtaaccgttaacgggtaaacgttaaacgtttaaaaccgggtaaaccgttcggggtaaccgggttaccgtaccggttaacccg

SEQ ID NO: 71255 - DNA, 679 bp, Homo sapiens
  misc_feature: GYAE6OF02ILNF9.51.32.C10.1.454.CMB.1.raw
  modified_base (185)..(185): a, c, t, g, unknown or other
  misc_feature (185)..(185): n is a, c, g, or t
  modified_base (639)..(639): a, c, t, g, unknown or other
  misc_feature (639)..(639): n is a, c, g, or t
tcagcgatcgtatacacgaccggtgctcgatttagtatagacatcaacacacaaaggggagtcagtctcagtcaggacacagcatggacatgagggtcccgctcagctcctggggctcctgctactctggctccgaggtgccaggatgtgactatccagatcgacccagtctccatcctttcccngtctgaccatctgtaaggagacaggacgtcacccatcaacttggccgggacaagacgtaagaaccattacggcagtactatttaaacttggtaattacagcaagaaaccgtaagggaaacgtaccccctaacctaccgtagacctacttacgtacgtcgtcgactaacgcctaacgttgacgtaaagtcgtacgacctacggtacgtacggttacgaggttacggccttacgggttcgggtaccggttaggggtaaccgtaggtttaaccgttttcgtacccggttcttacccggttacctaaggtttactaccgttaacggttctaccggtaccgtaaccttacgggtaacttagtttcgtaacctactttaccgtactcgtaacactagtaacgttacttaacttcgaccctagttcctagttacccgtacgtaacggtaccaacggttacnggtaaccgttagaaaccttcgtagtcggaccgttcaccgg

SEQ ID NO: 71256 - DNA, 547 bp, Homo sapiens
  misc_feature: GYAE6OF02IIXRQ.51.32.C10.1.454.CMB.1.raw
  modified_base (223)..(223): a, c, t, g, unknown or other
  misc_feature (223)..(223): n is a, c, g, or t
  modified_base (252)..(252): a, c, t, g, unknown or other
  misc_feature (252)..(252): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtagagacagagtcaccatcactggccggnaagacagaacatgcagctaattaatgtancagacaagaaaccgaggaaactcccctaaactctgactctatcgtctgcagcctacttgacaaagtcggatcccagttccgaaggttcaagtggactagggtgggtctagggctagtattctctacgtctaccagttancgtatctgacaacctgaagttatttnactaacttactactgtacaacgtaagtagttactaagtttcgaacctattacctacgtttccggacgtaacgggaccaccgtaacgtaggaagtaacgttaaacgaaccgttaggcggtacctagacccg

SEQ ID NO: 71257 - DNA, 557 bp, Homo sapiens
  misc_feature: GYAE6OF02I553M.51.32.C10.1.454.CMB.1.raw
  modified_base (104)..(104): a, c, t, g, unknown or other
  misc_feature (104)..(104): n is a, c, g, or t
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
tcagcgatcgtatacacgaccggtgctcgatttagtatagacatcaacacacaaagggggagtcagtctcagtcaggacacagcatggacatgagggtccccgntcagctcctggggctcctgctactctggctccgaggtgccagatgtgacatccagatgacccagtctccatcttccctgtctgcatctgtaggagacagatcaccatcacttgccgganaagacagaacattggcagtctaatttaaatggtatcagcaagaaacagggaacncccctaactctgatctaatgctgcagcctacttgactaaagtgagtcccagtcgaggtcaggtgactaggtgggtacgtaggggactaggtactttctactcgtaccaacctagttacgctacgtctacgacctaaacgtagtaacgttatttacgactaaacctttactactacgtacaaactaggtaacttaagtaactttccgacctagttcctacgtttccggacggtaacggacacggtaactaggactaacttaacgactggacgtactggacc

SEQ ID NO: 71258 - DNA, 561 bp, Homo sapiens
  misc_feature: GYAE6OF02JQ31W.51.32.C10.1.454.CMB.1.raw
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
tcagcgatcgtatacacgaccggtgctcgatttagtatagacatcaacacacaaaggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagcagaacattggcagctattaatggtatcagcagaaaccagggaacnccctaacgcctgatctangctgcagcctattgacaaagtgatccatcgaggttcagtgcagtggtctgggacagtactttcgtctctacacattagcctagtctgactaactgaatatttgacctaacttactacgtctacaactagtatttaaccgaattttccgaaccgtacttaccgtacgttttaccggaaccccggtaaagggtaacctaccgggtaaccttaggggtaaacgttaaccgtttaaaaccggaacgtttgggttaccggtacgttacgaacccgg

SEQ ID NO: 71259 - DNA, 578 bp, Homo sapiens
  misc_feature: GYAE6OF02H36J9.51.32.C10.1.454.CMB.1.raw
  modified_base (227)..(227): a, c, t, g, unknown or other
  misc_feature (227)..(227): n is a, c, g, or t
  modified_base (264)..(264): a, c, t, g, unknown or other
  misc_feature (264)..(264): n is a, c, g, or t
  modified_base (434)..(434): a, c, t, g, unknown or other
  misc_feature (434)..(434): n is a, c, g, or t
tcagcgatcgtatacacgaccggtgctcgatttagtatagacatcaacacacaaagggggagtcagtctcagtcaggacacagcatggacatgagggtccccgctcagctccgtggggctcctgctactctggctccgaggtgccagatgtgacatccagatcgacccagtctccatccttcctgtctgcatctgtagagacagagtcacatcacgttggccggganaagacagaacattggcagcttaatttaaattggtatnagcaagaaaccgaagggaacgcccctaactcctagatctaatgactgcacgcctactttacgacgtaaagtggacgtcccagtacgtaggttcagtggacgtaggtcgggtcgtagggactagtatttctctactccacgtattagctagtctcgaccaactagaagttntttcgactaacttctatacgtacaacgtagtagttactaattcgacccttagtactaccgtttaccggacgtaaacgggtacctaacggacgttagggaacgttaacttaaaccggtacgttaggtcgggtacctacgtacccg

SEQ ID NO: 71260 - DNA, 560 bp, Homo sapiens
  misc_feature: GYAE6OF02HBX76.51.32.C10.1.454.CMB.1.raw
  modified_base (278)..(278): a, c, t, g, unknown or other
  misc_feature (278)..(278): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (404)..(404): a, c, t, g, unknown or other
  misc_feature (404)..(404): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaaacncccctaacctcctagatctatcgctgcagcctactttgctaaagtggacgtcccatcgaggttcagtggcagtgggtctgggacngatttcnctctcacctatagcagcctgcagtctagtaagtnttttgacttaagtttattacttgtactagtacgtaagttaataaacttaaccgtcgggtaccctttaccggtaacgttacgttttcgggacccgtagggggtaacccaaggttccgtagggtaacgtagtaacccgtaaacggtacgtcggtacgg

SEQ ID NO: 71261 - DNA, 549 bp, Homo sapiens
  misc_feature: GYAE6OF02FG2F0.51.32.C10.1.454.CMB.1.raw
  modified_base (277)..(277): a, c, t, g, unknown or other
  misc_feature (277)..(277): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaacncccctaacctctgatctatgctgcagccactttgacaaggtggactcccatcgaggttcagtggcaggtgggtctgggacaggtactttcgcttctcacctattagctacgtctgacctaacctgaagttctttagctaacttacttactgtactaacgtagtaacgtttactaatttcgacccaattcctaccgtttcggacccgtaagggacctaaccggacgttagggacgtaacgttaaaccggtaacttaggtcggtacgtgtaccc

SEQ ID NO: 71262 - DNA, 579 bp, Homo sapiens
  misc_feature: GYAE6OF02FR5CZ.51.32.C10.1.454.CMB.1.raw
  modified_base (280)..(280): a, c, t, g, unknown or other
  misc_feature (280)..(280): n is a, c, g, or t
  modified_base (377)..(377): a, c, t, g, unknown or other
  misc_feature (377)..(377): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagtctaatttaaatggtatcagcaagaaaccagggaaacncccctaacctcctgatctatcgctgcagcctactttgacaaagtggacgtcccagtcgaggttcaggtggacaggttgggtctgggacagtatttcnctctctactattacgctagttctagactaacctgtaagttacttttagaccttaaacgtttactacgttacgtaccaaacgtagtaacgtttaactaactttcgaccctattcctaccgtttccgggaccgtaaacgggacctaacggtacgttaggaaacttaacgttaaaccggacgttcgggtacggactacggaaccc

SEQ ID NO: 71263 - DNA, 623 bp, Homo sapiens
  misc_feature: GYAE6OF02HOAYI.51.32.C10.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (303)..(303): a, c, t, g, unknown or other
  misc_feature (303)..(303): n is a, c, g, or t
  modified_base (489)..(489): a, c, t, g, unknown or other
  misc_feature (489)..(489): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtagganacagagtcaccatcacttggccggganaagacagaactagttggcagtcttaattttaaatggtatcagacaaggaaaccgaggaaacgtccccctaacgtccngacttctatcgctgcacgtacctatttcgactaaaggttcgtaccgtcccgagtcgggtaaggttctagggtaggtcgtagggttgggtccgtaggggtaacctaggttacttttcgtccgtaccttactaaccgtagttaccgcgtacgttacgtcgtaacctaacttaggaatttcgttttaanaccttaactttactacgtacgtaacgaacgtagttaacgtttaactacgttacaccctattcctacgtttcgaccgaaggtacacgtagtacggtacgtaacttaaccggtaattcgggtactccgtacgaccg

SEQ ID NO: 71264 - DNA, 557 bp, Homo sapiens
  misc_feature: GYAE6OF02GBXEW.51.32.C10.1.454.CMB.1.raw
  modified_base (279)..(279): a, c, t, g, unknown or other
  misc_feature (279)..(279): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctggtaggagacagattcaccatcacttgccgggacaagacagaacattggcagctaatttaaatggtatcagcagaaccagggaaacncccctaactctgatctatgctgcagcctatttgacgtaaagtggacgtcccagtcgtaggttcagtggctaggtggtcgtgggacagtatttctctctacactattgctacgtctgtacgaacctaggaatagttttgactaaacttcttactgtaccaagtagtacgttaataactttcgaccctattcctacgtttccggaccgtaacgggtaacctacggtaacgtaggtaaacgtaacgttaaacggtacgtcggttacggtacctacggtacc

SEQ ID NO: 71265 - DNA, 668 bp, Homo sapiens
  misc_feature: GYAE6OF02HYZ4I.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccggacaagacagaacattggcagtctaattaaagtgtatcagcaagaaaccgagggaaacgtccccctaaactcctacgatctatcgactcgcacgcctattttgacaaaggtcggactccagtcgtaaggttcagtcgcgtaggtgggtcgtgggaactaggttaactttcgacttctacctaaccgtatttaagcgtaacgttcctaggtacctaaaccgttaggtaaagttacctttttaacgtaccgttaaaacgtttaccgttaccttacggttaacccaaacgttaacggttaacggtttaaccctttaaaaggttttcccgtaaaccccttaacgttacccttaccggttttacccggaaccggtaaacgggtacaaacccggtaagtacggtaaaccgtaattttaaaccgggaaccttaagggtcggtacctaggtaccc

SEQ ID NO: 71266 - DNA, 560 bp, Homo sapiens
  misc_feature: GYAE6OF02HFTDB.51.32.C10.1.454.CMB.1.raw
  modified_base (282)..(282): a, c, t, g, unknown or other
  misc_feature (282)..(282): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttggccgggcaagacagaacattggcagctaatttaattggtatcagcaagaaaccgagggaaacncccctaactcctgatctatgctgcagcctacttgacaagtggactccatcgaggttcaggtcggactaggtgggtcgtaggggactacggtatttctctctacctactattagctagtctgacctaacgtggtaagttatttacgacttaacttactactcgtacaacgtagtattaactacgttcacctattccgtacgtttacggaccggtaaggtacctacggtacgtaggtacgtaacgttaaacggtaccgtaggtacggtactacgtacccg

SEQ ID NO: 71267 - DNA, 577 bp, Homo sapiens
  misc_feature: GYAE6OF02GPB4H.51.32.C10.1.454.CMB.1.raw
  modified_base (198)..(198): a, c, t, g, unknown or other
  misc_feature (198)..(198): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttcctgtctgcatctgtagganacagagtcaccatcacttgccgggcaagacagaacattggcagctatttaaatgatcagcaagaaaccagggaaacgcccctaaactccgtgactctaatgctgcacgcctacttgacaaaggtgacgtcccataccgaggttcagtcggctaggtcgggtctagggactagtatttacctcgtactcaacctattagactagttctagactaaccgtaggtaaattattttacgacctaaacttactacgttagacctaagtagtaacgttaactaaattcgaccctagtcctacgtttacggaccgtaaaggtaaccaccgtaacgtacggtaagtaaacgttaaaccgtaacggtcggttacggacgtagaacccg

SEQ ID NO: 71268 - DNA, 656 bp, Homo sapiens
  misc_feature: GYAE6OF02GQ02S.51.32.C10.1.454.CMB.1.raw
  modified_base (284)..(284): a, c, t, g, unknown or other
  misc_feature (284)..(284): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttcggccgggacaagacagaacattggcagcttaatttaaagtggtatcagcaagaaaccagggaaacncccctaactcctgatctatgctgcacgcctacttgactaaagtggactacccagtcgtaggttcagtcggctaggttgggtcgtgggaactaggtactttctcgttctacaccgtattacgctagtcctgacctaaccgtaggaacttacgttttgaacctttaacgtttacgtacgttacgtaacctaaacgtagttaacgttttaaaccgaacgtttttccgaaaccctttaattacccgtttaacctttaccgggggtaacccgtaaaacgggggtaaccctaaaccgggtacgttaacgggtaaaccgtttaaacggtttaaaaccccggtaacggttcggttaacgggtaccgttacggtaaccccg

SEQ ID NO: 71269 - DNA, 638 bp, Homo sapiens
  misc_feature: GYAE6OF02HHSNP.51.32.C10.1.454.CMB.1.raw
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
tcagcgatcgtatacacgaccggtgctcgatttagtatagacatcaacacacaaaaggggggagtcagtctcagtcaggacacagcatggacatgagggtccccgctcagctcctggggctcctgctactctggctccgaggtgccagatgtgacatccagatcgacccagtctccatcttccctgtctgcatctgtaggagacagagtcaccatcacttgccgggcaagacagaacnttggcagcttaatttaatgtatcagcagaaccaggaacncccctaactcctagactcgtatgctgcacgcctacgtttgactaaaggtcggactcccagttacggacggtttcgaggttcgggacgtaggggttcggggtacgtaggggaactaggttacgttttccctacttccgtacctaaccttacgttacggacctaggttcctacggtaccctaaaccgttaggtaaacgtttattttacgaaccttaaacctttacttaaccgttacgttaacctaaacgtaaggtaacgttttaactaactttccgaccctattcctacgttaccggaccgtaacgggaacctacggtacgtcggtaactaacgttaaaccgacgttggtacggtcctgaccc

SEQ ID NO: 71270 - DNA, 727 bp, Homo sapiens
  misc_feature: GYAE6OF02GIOP3.51.32.C10.1.454.CMB.1.raw
  modified_base (184)..(184): a, c, t, g, unknown or other
  misc_feature (184)..(184): n is a, c, g, or t
  modified_base (541)..(541): a, c, t, g, unknown or other
  misc_feature (541)..(541): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctccatccttcccngtctgcatctggtaggagacagactccacatcacgttcggccgggacaaagacctagaactagttcggcagtactttaattttaaagtggtaactcgagctaaaggaaacccgaagggaaacctcccctaactccgtagaacttctaagtcgctgtaccgacgtccctaagtttcgaacgtaaaggttcggaaccttaccccgaaggttaccgggtaggtttacgagggttacggacgttaaggggttcgggttaccgtaggggaacttacggttacttttaccgcttacgtaccctaagtaagtttacgccgttaacggttcctacgggtaaccctaaacgttgttaaacggtttnttttaccgaaacctttaaccgtttacttaccgtagtacccaaaggttaacgttaccgttaattaacgtttcccgaaccttagtttacccgttacgttacccgggaaccgttaaagggacccctaaggtaaccgttggtaaattaaaccgtttaaacggccgtttagggtcccgtacctggtaaccc

SEQ ID NO: 71271 - DNA, 553 bp, Homo sapiens
  misc_feature: GYAE6OF02H3VH3.51.32.C10.1.454.CMB.1.raw
  modified_base (197)..(197): a, c, t, g, unknown or other
  misc_feature (197)..(197): n is a, c, g, or t
  modified_base (359)..(359): a, c, t, g, unknown or other
  misc_feature (359)..(359): n is a, c, g, or t
  modified_base (545)..(545): a, c, t, g, unknown or other
  misc_feature (545)..(545): n is a, c, g, or t
tcagcgatcgtatacacgaccggtgctcgatttagtatagacatcaacacacaaaggggagtcagtctcagtcaggacacagcatggacatgaggtccccgctcagctcctggggctcctgctactctggctccgaggtgccagatgtgacatccagatgacccagtctccatcttccctgtctgcatctgtagganacagagtcaccattcacttgccgggcaagcagacattggcagctattaaatggtatcagtcagaaaaccagggaaacgcccctaaccgttacctgaactctatgctgcagcctacgtttcgactaaagtcgacgtccagtccgagttccagtgcagtcggtngggactaggatttctcgtctcaccgtattacgcgtacgtctagaccaacgttagacgttattttcgactacgttaatcgtagtacaacgaagtaacttaacatttcgccctaatctacgtttccgaccgtaagggaccacgtaacgttcggaacgttaacttaaaccggacttacggtacgtacgngtaacccg

SEQ ID NO: 71272 - DNA, 608 bp, Homo sapiens
  misc_feature: GYAE6OF02JGWYD.51.32.C10.1.454.CMB.1.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (392)..(392): a, c, t, g, unknown or other
  misc_feature (392)..(392): n is a, c, g, or t
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
  modified_base (537)..(537): a, c, t, g, unknown or other
  misc_feature (537)..(537): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttcctgtctgcatctgtagganacngatcacatcacttgccggacaagactagaactagttggacagtacttaattttaaagttggtactacgagacctaaaggaaaaccgaggggaaaacctccccctaaacctccgtagacttacctagtcgcttacgacacgtcctacgttgaacgtaaagtgaacgtccgagttcgaaggttcgagtggacnggttcggacttgggactgtntttactctactcgaacctagttacgntacgtctcgaacaccgttagagtttaccgtttagaacttaccgtttaagtcttaaggtacctaaaggtactttaaggttacttaacgttcgaaccgttntaccgttacgttccggaactaacgggactacggataggaattacgtaaacggtatggtacgactcgtaccg

SEQ ID NO: 71273 - DNA, 616 bp, Homo sapiens
  misc_feature: GYAE6OF02I8I91.51.32.C10.1.454.CMB.1.raw
  modified_base (278)..(278): a, c, t, g, unknown or other
  misc_feature (278)..(278): n is a, c, g, or t
  modified_base (390)..(390): a, c, t, g, unknown or other
  misc_feature (390)..(390): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttcctgtctgcatctgtaggagacagagtcaccatcacttgccggcaagacagaacattggcagcttatttaaattggtatcagcacgaaacgagggaaacncccctaactcctgatcatgctgcagcctactttgactaaaggtgacgtccagttcggagttcagtggctaggtcgggttctaggggactagtacttttcgtctctaccactnttaacgctaggtctcggacctaacgtagtaagttattttcgaccttaaccgttacgttaactcggttaactaacgtaacgtaagtttaaccctaaacttttccggacccttacgttaaccttacgttttacccgggaacccgtaaggggtaacccttaaccggtagtaacgggtagtaaaaccgttttaacgggaacccttgggtaaccggtaccgttggtaaccc

SEQ ID NO: 71274 - DNA, 814 bp, Homo sapiens
  misc_feature: GYAE6OF02HTXL7.51.32.C10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcctccatccttcctgtctgcatctgtagganacagacgtcaccatcctacgttgccgggacaacgacaagaactagttcggacagtacttaagtttaagttggtatacagacgaacgaaaccgaacgggaaaccgtaccccttaacctccgtacgtaactacttaacgtcgtactcgaccgacgtacccttacgtttacgaacgtaaaacggttcggtaaccgttaccccgtagttaccggttaacggttacgtacgggttaggaccgttaggggtacgggtttaccggtacggggtaacgttaacggtttacttttaccgtttaccgtttaccgttacctaacccgttacgttaccgaacggtaccgtaccggtaccgtacggtacggttaacgtacgttaaggttaaacgttttaacgttttacggttaacttttaaacgttttaaccgtttaccgttacgttaccgtaacgttacgttaaacgtttaaacgttaaaccgttaccgttaccggttacccgtttaccggttaccgtttaaccgggtttttaccgggaacccgggttaaccggggtaacccggtaacggtacggtaacgggtaaaccggttaaccggtaaccggttaaaccggttaggttacggg

SEQ ID NO: 71275 - DNA, 557 bp, Homo sapiens
  misc_feature: GYAE6OF02HW33Y.51.32.C10.1.454.CMB.1.raw
  modified_base (346)..(346): a, c, t, g, unknown or other
  misc_feature (346)..(346): n is a, c, g, or t
  modified_base (352)..(353): a, c, t, g, unknown or other
  misc_feature (352)..(353): n is a, c, g, or t
  modified_base (421)..(421): a, c, t, g, unknown or other
  misc_feature (421)..(421): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaaccatcacttgccgggcaaagacagaacattggcagcttaatttaaattggtatcagcaagaaaaccgaggaaacgtccccgtaacctcctgatctatgctgcagtcctactttgataaagtgactccatcgagttnagtggnnggtggtctgggactagtatttctctctacactatacgactagttcagtacaaactagtaagtactttnacctaacttaatactagtacaaagtagtaacttactaattcgacctatacctacgtttccggaacgtaaacgggactaaccggtactacgggaagtaaacgttaaaacggtaacctggtaacggtactaggtaacc

SEQ ID NO: 71276 - DNA, 564 bp, Homo sapiens
  misc_feature: GYAE6OF02IZXMB.51.32.C10.1.454.CMB.1.raw
  modified_base (408)..(408): a, c, t, g, unknown or other
  misc_feature (408)..(408): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacgttcgccgggacaagacagaacattggcagacttatttaaattggtgtacagcaagaaaccgagggaacgcccctaacctcctagatctatcgctgcacgcctacgtttcgactaaaggtcggacgtcccagttacgtaggttacaggtcggataggtgggtcgtagggacctagtactttctctctctactntagctagtctgactactagtattatttcgactaacttactactacgtacaacgtagtagttaactattcgtacctgttacctcgttacggaccgtaaggacctacggtacgtacggtaagtaacgttaaccgtactaggtaccgtgtacgtacccg

SEQ ID NO: 71277 - DNA, 577 bp, Homo sapiens
  misc_feature: GYAE6OF02I7A5O.51.32.C10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtagganacagagtcaccatcacttcggccgggacaagacagaacattggcagtcttaatttaaattggtatcagcaagaaaccgagggaaacgcccctaacctctagatctatcgctgcacgtcctacgtttgactaaaggtggacgtacccagtcgtaggttcaggtggacgtaggtcgggtcgtgggactagttactttacctctctaccacctagttagactagtcgtacgacctaacgttagtaattacgtttacgaccttaacttacttactacgtacaacgtaagtacttaactacttacacctattcctacgttaccgaccgaacgggtacacggtacgtacggaagtaacgtaacgacgtaggtcgactgaaccc

SEQ ID NO: 71278 - DNA, 661 bp, Homo sapiens
  misc_feature: GYAE6OF02IHEPY.51.32.C10.1.454.CMB.1.raw
  modified_base (227)..(227): a, c, t, g, unknown or other
  misc_feature (227)..(227): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctccatccttcctgtctgcatctgtaggagacagacgtcaccatccacttggccggnaagacagaacattggcagacttaatttaaatggtatcagacaagaaaccgagggaaaccgaccccgtaacctcctagactactatcgctcgcacgtcctacgtttcgacgtaaagtcgggacgtacccagtacgtacggtttacgaggtcggacgtaggttcggggtacgtacgggaacgtagttactttcgtcctctacctaactagttacgcgtacgtctacgacctaactagtaacgttacgtttagacctaacgttactaccgttacgtactaaacaacggttaacgttaacttaaacttccggtacccttaacgttaccttaccgtttcccggaaccgtaaacggggtacctaacgggtaccggttaacggtaaacggttaaacgttaaacggtaaccgttaccgggtacggtccgtacggtaaccccg

SEQ ID NO: 71279 - DNA, 728 bp, Homo sapiens
  misc_feature: GYAE6OF02ICSSU.51.32.C10.1.454.CMB.1.raw
  modified_base (341)..(341): a, c, t, g, unknown or other
  misc_feature (341)..(341): n is a, c, g, or t
  modified_base (435)..(435): a, c, t, g, unknown or other
  misc_feature (435)..(435): n is a, c, g, or t
tcagcgatcgtatacacgaccggtgctcgatttagtatagacatcaacacacaaagggggagtcagtctcagtcaggacacagcatggacatgacgggtccccgctcagctcctggggcctctgctactctggctccgaggtgccagatgtgacatccagatcgacccagttctccattccttcctgtctgctatctgtacgagacagtagtcaccatccacgttggcccggaaagaccagactagttggacagtaccgttaatttaacgttaggttataccgaggacaacggaaaccgtaaggggtaaaccacccccgttaacgtcctaggattacctancgtactcgaccacgtaccctagttacacgaaggtgaccgtcccagttacgtagtacgagttcggactgggttacggcgtagggtctaacggttntttaccgtcgtaccgttaccgaactagtttacgcgtaacggtcaccgtacgtaacccgtagaacttttacgtttactaacctaaccgttttaagtcccttaggtaacctaaacggtcgtaaaccgttttaactaacgggttttacccaacccgtacgtttaccccgtaccggtttttaaccggaacccggtaaacgggttaacccgttaccggtaaaccgggttaacggtaaggttaaaccgtttaaacccgggtacgttaacgggtacggtacccccgggttataaccccgg

SEQ ID NO: 71280 - DNA, 646 bp, Homo sapiens
  misc_feature: GYAE6OF02I2ASU.51.32.C10.1.454.CMB.1.raw
  modified_base (199)..(199): a, c, t, g, unknown or other
  misc_feature (199)..(199): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccggagtgccagatgtgacatccagatgacccagtctccatcttccctgtctgcatctgtagganacagagtcacatcacgttcgccgggacaagacagaactagttgcagtcttaagtttaaattggtatacagacaagaaaccaagggaacacccctaaccgtcctagatactatcgtactcgcacgtacctactttagacgtaagtggacgtacccagtcgtacgttcgagtaggcaggtgggtacgtgggactagtacttacgtctctacactattagcagtctagaccaacgtagtaacttacgtttaacgacctaaaccttacttacgtacgtaccgtaaactaaggtaagtttaaccttaaagtttccgaacccttaattaccgttaccggtttaccggtaaacccggtaagggtaacccgtaacggtaaccgttaacgggtaaacgttaaacggtttaaaaccggtaccggtttaagggtacggtacccgttaccgtaaccccg

SEQ ID NO: 71281 - DNA, 939 bp, Homo sapiens
  misc_feature: GYAE6OF02IEQ8L.51.32.C10.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtagganacagagtcacatcacttgccggnaagacagacagttgcagtctaatttaaagttggtatcagacaaggaaaccagggaaacgaccctaaccgtcctagactctatcgtactgcgacgtcctacgttttcgacgtaaaggtcggtaacgtccccaaggttaccgtaacgggtttcaaacggggttcggtacgtaacggggttacggggttccggttaacgggggaaccgtaacggtttacgtttttcccgtttaccggttaccccgttaacctaacccgttaaaggttttaaccgggtaccgttaaacggtttcccgttacggttaacccggtaaaacccgtttaacgggttaaaacgtttacggtttttttaaccgggtaaaccccgtttaaaacctttttaacccgtttaaacccggttttacccgggtttaaaacccgtaaaaacccggtttaaaacgggtttaaaccgtttttaaaacccgttaaacgggtttttttaccccggtaaacccccttttaaacccgggtttacccctttttaaaccccggggttttttaaacccgggggtaaaaccccggtaaaacccgggggtaaaaccccggtttaaaccgggttaaaccccgggttttaaacgggggttaaaccgttttaaaaaccggggtttaaaaacccggtttaaacccgggtttaacggggtttaacccggggtacccggttttaccggtaaaaccccccgg

SEQ ID NO: 71282 - DNA, 688 bp, Homo sapiens
  misc_feature: GYAE6OF02I9ZEG.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctccatccttccctgtcctgctatcgtggtaggacgacgagacgtccaccactcctacgttcggaccgggacaacggactaaggaactggttcggactaacgtactttaaattttaaagttcggtatccgaagaccaaaggaaaaccgacggggaaaccctccccttaaccgaccgtagacttcatcgctcgactacgtacctacgttagaaccgtaaggtcgaccgttaccacggttcggtacgttacggtcggtggacgtttaagggtcgggtacgtaccgggtacgtagtttacctttccgtactcccgtaacctaacgtatttaccgacgttacgtacttccgaaccttaacgttaggtaatttacgttaccctaccttaaagtttaccgtgtacccgtaaacgaacgttaggttaacccttataaccgtttccaaccttgttaaccgtcgttaccggaacgacgggtaccagtaccgattaacgtaaagccgttagccggacttcgagtaccc

SEQ ID NO: 71283 - DNA, 796 bp, Homo sapiens
  misc_feature: GYAE6OF02J217F.51.32.C10.1.454.CMB.1.raw
tcagcgatcgtatacacgaccggtgctcgatttagtatagacatcaacacacaaagggggagtcagtctcagtcaggacacagcatggacatggacgggtccccgctcagctccgtggggctcctgctactctggctaccggaggtcgccagatgtagacatccagatcgacccagtcctccattccttcccgtgtctgcagttcgaggtaggactacagtaactccacctagttccacgttcgggacccgggacaaacggactaacggaactagttcggacctaggtaccttaagtttaaacgtggtaactacgagaccaaggaaaccgaaggggtaacctacccccgttaacctacgtacggtacttaccgtacgtgtaccttacggcctaacggtaccgttaccgtttacggaccgtaaaggtccgggtaaccttcccgaggttacgtaaccggttcgaggttcgggaacgttaccgggttgggttacggtacgggtattaacgggtcctttccgccgttacctaccgtaacgttacgtagtccgttagacccgtcgtacgtaccgttagtaactttcgttacgaaccgtttaacttaccgtaacgtttacgtaacccgtaaacgttaggttaaccgttacgtttaaccgtaccgtaccctacggtttacccttaccgggttacccgtaaccggtaacggtaaaccttaggtaaaccggtttaggaaacccggtaaacggttttaccggtaacccggttaagggtccccggtttaacgacccgttaaccccgg

SEQ ID NO: 71284 - DNA, 573 bp, Homo sapiens
  misc_feature: GYAE6OF02GQPVK.51.32.C10.1.454.CMB.1.raw
  modified_base (233)..(233): a, c, t, g, unknown or other
  misc_feature (233)..(233): n is a, c, g, or t
  modified_base (381)..(381): a, c, t, g, unknown or other
  misc_feature (381)..(381): n is a, c, g, or t
  modified_base (416)..(416): a, c, t, g, unknown or other
  misc_feature (416)..(416): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgctatctagtaggagacagacgtcaccatccacgttcggcccggganaaagacgaagaacagttggacagcttaattttaaagtggtatcagtcaagaaaccagggtaaaccgcccctaaactccagatctatgctgcagcctattgactaaggtgacgtccagtcgtagttcagtgacagtgggtcgtgggacngtactttctcttctcgactattacgcgtagttccngtacctaactgtaacgttatttacgtactaaccgtttactacgttacgtacaacgtaagtacgttaactagtttcgacctacttaccgtacgtttaccgacggtaacggaccacggtacgaggtaataacgttaacgagttaggtcgtactagtacc

SEQ ID NO: 71285 - DNA, 694 bp, Homo sapiens
  misc_feature: GYAE6OF02IDMA3.51.32.C10.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagatcgacccagtctccatccttccctgtctgcatctggtagganacagngtcaccatcacttggccggacaagacaagaacagttggcagcttaatttaaattggtaatcagacaacgaaaccgacgggaaaacgtccccttaacctcctagtaactctatcgactgacgacgtcctactttacgacgtaaagtcggacttcccagtcgtaggttcgaggtcgtcgtaggttgggtacgtgggactagtactttcctccgtactacgtaactagttagaccgtaagttccgtacgtacgtaaacccgttaaggtaaacggtttactttttacgggaacttaaacccgttttaccgttaaacgtttaccggtaaccaaacgttaacggtaacgttttaaccgtaacttttacccggaccttaacgtaccgttaccgttaccggaacccggtaaacggacccgtaaccggtaccggttaaggtaccggttaaaacttaaccggtaacggtttcggtacggtcccgtaacggtacccg

SEQ ID NO: 71286 - DNA, 735 bp, Homo sapiens
  misc_feature: GYAE6OF02HAUO5.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccaggatgtgacatccagatgacccagtctccatcttccctgtctgcatctgtaggagacagacgtcaccatcacttcgccgggacaagacagaacattggacagtacttaacttttaaagttggtactcgaagtaccaaggaaaccgaaggggaaacgtacccccgttaaacctcccgtacggaacttctaagtcgcgttacgccaacggtcctaaccgtttgaccgtaaaaggttcgggaccgtaccctacggttaccggtacgggtttaccgagggttacggccggtaaggttcggggttacgtgggggtacctaaggttacttttccctcgtaccgttaccaaccgttagttaccggacctaggtacctcgaacccgttaaccgtaggtaaacgttacttttacgacttaaacctttaccttaacgttacggtaaccgtaaacggttaagttaaccgtttaacttaaacgtttcgaaccctttagtacccttagggtttacccgaccggtaaacgggacctaaccggaacgttacgggtaaagtaacgtttaaaccgggaaagttccggtaacggttcgtacggtaccc

SEQ ID NO: 71287 - DNA, 541 bp, Homo sapiens
  misc_feature: GYAE6OF02FM8CB.51.32.C10.1.454.CMB.1.raw
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggnaagacagaacattggcagcttatttaatggtntcagcagaaaccagggaacncccctaactcctgactctatgctgcagccattgacaagtgacgtccatcgagtcagtgcaggtggtctgggactagtcttttacnccgttctacacctagttacgccgtaagtcgtacgactaacgtgtaaacgttnttttcgactaacgtttacatacgtacaacgagtacgttaacatttcgccctattcctacgtttcggaccgtaagggaccacggtacgtcggaactacgttaaacggacctaggttcgacgttgaaccc

SEQ ID NO: 71288 - DNA, 650 bp, Homo sapiens
  misc_feature: GYAE6OF02HH4EK.51.32.C10.1.454.CMB.1.raw
  modified_base (394)..(394): a, c, t, g, unknown or other
  misc_feature (394)..(394): n is a, c, g, or t
tcagcgatcgtatacacgaccggtgctcgatttagtatagacatcaacacacaaagggggagtcagtctcagtcaggacacagcatggacatgagggtccccgctcagctccgtggggctcctgctactctggctccggaggtgccagatgtgacatccagatcgacccagtctccatccttccctgtctgcatctggtaggagacagagtaccaccatccacttggccgggacaagacaagaactattggacagtacttaatttaaagttggttatcagacgaacggaaaaccgaagggaaacctacccccgtaacctccgtagtactctatgtctgacacgtcctattcgactaaaggtcggactccctagtcggtagttacgaggtacggngtacgggttgggtcgtagggactagttactttcctctactactacctatacgctagtctacgactacgtagacgttatttcgaactaacttactacttacgtactaacgtaggttaacttaagttaactttccgaacccctttagttccccgttaccgtttaccgggaacccgtaaaggggtaccctaacggtaacggtaggaaacgttaacggttaaaccggaacgttacggtacggtacccgtacgtaacccgg

SEQ ID NO: 71289 - DNA, 653 bp, Homo sapiens
  misc_feature: GYAE6OF02GBDYO.51.32.C10.1.454.CMB.1.raw
  modified_base (285)..(285): a, c, t, g, unknown or other
  misc_feature (285)..(285): n is a, c, g, or t
  modified_base (457)..(457): a, c, t, g, unknown or other
  misc_feature (457)..(457): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttcctgtctgcatctgtaggagacagagtcaccatcacttggccgggacaagacagaacattggcagtctatttaaattggtatacagtcaagaaaccgagggaaaccnccccgtaacctccgtagactactatgctgccacgtcctactttggactaaaggtcggacgtcccaagttccggaggttcaggtcggcgaggttgggtcgtagggactagttacgtttcctcgttctacgtacctattacgactagttcctggacctaaccgtgtaaacgttntttaacgaccgtttaaaccttacttaccgttacgtacctaaacgtagttaacgtttaacctaagttttccgaaccttaccgttacgttaacccggttttccggaaccggttaaacgggaccctaaccggtaaccgttacgggaaacggttaacttaaaacccggttacgtagggtaccggtacgtacgtaaccccg

SEQ ID NO: 71290 - DNA, 715 bp, Homo sapiens
  misc_feature: GYAE6OF02F8Z72.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccggcaagacagaacatgacagtctaattttaattggtatcagacaacgaaaccgaagggaaacgtccccctaaactcctagatctatcgctagcacgtacctacgtttacgactaaacggtggtaccgtaccctagttcggtaaggtttacgagggttggaccgtagggttcgggtaccgtggggactaggttacttttctaccgttcctaccgtaacccttagttaacggtctaacggttccgtacgtaccgttaaacgtcggttaaagtttaacgtttttacgaaacctttaaccgtttaacgttaccgtttaggtaacccgtaaacgttaaggttaacgttttaaaccgttaactttcccggtaaccctaacgtttacccgttaccggtttaacccggaaccgggtaaaccgggaacctaaccgggttaacgtaacgggtaaacgttaaccgtttaaaacgggtaaacgttggtacgggtccctacgtaaccc

SEQ ID NO: 71291 - DNA, 617 bp, Homo sapiens
  misc_feature: GYAE6OF02HKIMP.51.32.C10.1.454.CMB.1.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (351)..(351): a, c, t, g, unknown or other
  misc_feature (351)..(351): n is a, c, g, or t
  modified_base (400)..(400): a, c, t, g, unknown or other
  misc_feature (400)..(400): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccggnaagacagaacattggcagctaatttaatgtatcagcaagaaaccagggaaacncccctaactcctagactactatgctgcagcctagtttgacaaaggtggacgtcccagttcggaggttcaggtggngaggtgggtcgtgggactagtactttactctctcactattagcgtatcncgtacaacctaggtaagttactttacgacttaacttaccgtacttacgtaccaaacgttagtaacgtttaactaagtttaccgaccctaacgttacctaccgttttaccggaacccggtaaacgggtaacccgtaaccggtaaccgttaacgggtaaacggttaaacgtttaaaccggtaaaccggtttacggtacgggtaccgttacggtaacccg

SEQ ID NO: 71292 - DNA, 631 bp, Homo sapiens
  misc_feature: GYAE6OF02F6ESK.51.32.C10.1.454.CMB.1.raw
  modified_base (200)..(200): a, c, t, g, unknown or other
  misc_feature (200)..(200): n is a, c, g, or t
  modified_base (318)..(318): a, c, t, g, unknown or other
  misc_feature (318)..(318): n is a, c, g, or t
  modified_base (330)..(330): a, c, t, g, unknown or other
  misc_feature (330)..(330): n is a, c, g, or t
  modified_base (533)..(533): a, c, t, g, unknown or other
  misc_feature (533)..(533): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatctgtagganacagagtcaccatccacttcggcccgggacaaagaccaagaactattcggcagtacttaattttaaattggtatcagacaagaaaccgagggaaacgcccctaactcctagatacctntcgctagccacncccttatttcgaactaaggtggacctccagtacggtaggtacaggtggtacgtaggtgggtacggtacgggagtacgttactttctactcctccgaacttacgttacgctacgttctcggtacctaacgtagttaacggttattttacacttaaacttacttactacgttacaacgttaagttaacgttaaacttactttacncccgttaactccgtacttttaccggaccggtaacggaacgtaccgtaacggtacgtaagttaacgttaactacggttacggcgtacgtaccgtacccg

SEQ ID NO: 71293 - DNA, 696 bp, Homo sapiens
  misc_feature: GYAE6OF02IW1IQ.51.32.C10.1.454.CMB.1.raw
  modified_base (171)..(171): a, c, t, g, unknown or other
  misc_feature (171)..(171): n is a, c, g, or t
  modified_base (198)..(198): a, c, t, g, unknown or other
  misc_feature (198)..(198): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcnccatcttccctgtctgcatctgtaganacagagtcaccatcacttcgccggacaagacaagaacagttggcagcttaatttaaagttggtactcgacgcaagaaacccgaagggtaaccgtccccctaaaccgtcctagactctaatcgactcgactacggtcctacgtttgacgtaaagtcggaaccgttcccgagtaccggtaggttaacgtggtacggtaccgtagggttcggggttaccggttagggaaccgttaggttactttaccggttacctacttaccgtaccgttattaacgacgttacgtaccgtacgacctaaacgttagtaacgttatttacgaccttaacgttactaccttagaaccgtaacgtaagttaactttaccgttaattaccggtaaccctagtttacccgttacgtttaccgggtaaccgtaacgggtaaccgtaccgtaaggtacgggtaaaccttaaacgtttaaacggtaacgtacgggttacggtaccgtacgtaaccccg

SEQ ID NO: 71294 - DNA, 589 bp, Homo sapiens
  misc_feature: GYAE6OF02JNG4F.51.32.C10.1.454.CMB.1.raw
  modified_base (182)..(182): a, c, t, g, unknown or other
  misc_feature (182)..(182): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (267)..(267): a, c, t, g, unknown or other
  misc_feature (267)..(267): n is a, c, g, or t
  modified_base (317)..(317): a, c, t, g, unknown or other
  misc_feature (317)..(317): n is a, c, g, or t
  modified_base (438)..(438): a, c, t, g, unknown or other
  misc_feature (438)..(438): n is a, c, g, or t
  modified_base (454)..(454): a, c, t, g, unknown or other
  misc_feature (454)..(454): n is a, c, g, or t
  modified_base (503)..(503): a, c, t, g, unknown or other
  misc_feature (503)..(503): n is a, c, g, or t
tcagcgatcgtatacacgaccggtgctcgatttagtatagacatcaacacacaaaggggagtcagtctcagtcaggacacagcatggacatgaggtccccgctcagctcctgggctcctgctactctggctccgaggtgccagatgtgacatccagatgacccagtctccatccttcccgtntcctgctatctagtaggagacagtactccgaccagtcacttgccgggtacagacagaacagtcgnagctatttaagtgtatnagnaacgtaacgaggaaaccgtcccaacctctgaacttctaactggcctgacncggtaccctagttcgaacgaaagttcgggacttacccgagtccgtaaggttcgagtcggtacgtaaggtcgggtcgtacgggactagtcgtttctacgtctaccaccgtattagctagtcngtcaaccgtgaagttnttcgactacttactactacgacgtacagttaacgttacctagtttaccnctacgttctaccggttacgacgaacgggactaccggtaagcggttaaccgaagtttaaacgcgttaccggcggtacctaggtaccc

SEQ ID NO: 71295 - DNA, 687 bp, Homo sapiens
  misc_feature: GYAE6OF02F0JF5.51.32.C10.1.454.CMB.1.raw
  modified_base (227)..(227): a, c, t, g, unknown or other
  misc_feature (227)..(227): n is a, c, g, or t
  modified_base (663)..(663): a, c, t, g, unknown or other
  misc_feature (663)..(663): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcctccatcttccctgtctgcatctgtaggagacagagtcaccatcacttggccggganaagacaagaacagttggcagtacttaattttaaagttggtaattcgaagacaacggaaaacccgaagggggaaaccgtaccccctaacctacctaggacttactacgtcgctagccacgtaccttactttagaccgtaaaggttcggaacgtacccgtagttcggtaacggtttcgaggttacggacgtacgggttggggtcgttaggggaactggttaccttttccgtcgtacctacgtaacccttagttacggacttagttccgttaggacccttaaacgttaggtaactttagtttcgaaacctttaccgttactacttacgtactaaacgtagttaacgtttaccttaaacgtttccgaacccttattacccgttacgtttacccggacgtaacgggaccacggttactaacgggaattaaacgttaacgtntttacggacggtccgtacaacccg

SEQ ID NO: 71296 - DNA, 710 bp, Homo sapiens
  misc_feature: GYAE6OF02H9NH4.51.32.C10.1.454.CMB.1.raw
  modified_base (228)..(228): a, c, t, g, unknown or other
  misc_feature (228)..(228): n is a, c, g, or t
tcagcgatcgtatacacgaccggtgctcgatttagtatagacatcaacacacaaagggggagtcagtctcagtcaggacacagcatggacatgacgggtccccgctcagctccgtggggctcctgctactctggctccgaggtgccagatgtgacatccagatgacccagtctccatccttcctgtctgcatctagtaggagacagagtcacatcacgttggccgganaagacaacgaactagttgacagtacttaaattttaaagtggttaatacgagtaccgaaacggaaaaccgaagggaaaacccgtaccccccttaaacctccgtagtactctaagtcgacgtgccaacgtcccttaacgttgaacgtaaaggtcggacgtacccaggtaccggtagtacgtaggtcggactaagggttcgggtacgtaggggtacctaggttactttcgtaccttacctaccgaacctagttacgccgtagtctacgtaacctaacgtgtaaagttgttttagaacctaacgtttacgttaccgtaacgttaccaaacgtaacgttaacgtttaaaccgttacttaccgtaccctaacgttccgttaaccgttttacccgggaacccggtaaagggtaaccctacgggtaacccgttaaggtaaccgttaacggttaaaccgtacgggttaccgtaggtaccctacggtaaccc

SEQ ID NO: 71297 - DNA, 637 bp, Homo sapiens
  misc_feature: GYAE6OF02F40X3.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcctccatcttccctgtctgcatctgtaggagacagagtcaccatccacttgcccgggacaagacagaacattgggacagtcttaattttaaaagttggtaatcgagctaagaaaccgaaggggaaacgcccccttaaacctcctagactctatgcctgcacgcctattgcaaagtgactcccatcgtaggttcaggtgacgtggttcgggtctggggaacctaggttacttttccgtctaccgtaccaacccttaagttacgactacgttccgtacgacctaaaccgttgtaaacgttgttttacgaccgttaaacctttagtaacctgttaaccaaacgtacggttaaacgttactaagtttccggaaccctattaccgttaccgtttacggaacccgttaagggaacctacggtaacgtggtaaagtaacgtaaaccgtacgttaggaccggttactacgtaaccc

SEQ ID NO: 71298 - DNA, 590 bp, Homo sapiens
  misc_feature: GYAE6OF02G3251.51.32.C10.1.454.CMB.1.raw
  modified_base (200)..(200): a, c, t, g, unknown or other
  misc_feature (200)..(200): n is a, c, g, or t
tcagcgatcgtatacacgaccggtgctcgatttagtatagacatcaacacacaaagggggagtcagtctcagtcaggacacagcatggacatgagggtccccgctcgagctcctggggctcctgctactctggctccgaggtgccagatgtgacatccagactgacccagtctccatcttccctgtctgcatctgtaganacagatcacatcacttgccgggcaagacagaacagttggcagacttaatttaaatggtatcagacaagaaaccagggaaacgcccctaactcctagatcctatcgctgcagccactttgacaaagtgacgtcccagtcgaggttcagtgactaggtcgggtacgtgggtactagtactttctactcgttacctacctaagtttagaccgttagtccgtcgacgtaaccgttaggaaatacttttagacctaaccttaatactacgtacaacgtagtacgttactaagtttacgacctagtacctacgtttaccgacccgtaaacgggaactaccgtaacggtacggtaacgtaagttaaaccgtacgtacggttacggtactacggaacc

SEQ ID NO: 71299 - DNA, 666 bp, Homo sapiens
  misc_feature: GYAE6OF02HB1NG.51.32.C10.1.454.CMB.1.raw
  modified_base (203)..(203): a, c, t, g, unknown or other
  misc_feature (203)..(203): n is a, c, g, or t
  modified_base (342)..(342): a, c, t, g, unknown or other
  misc_feature (342)..(342): n is a, c, g, or t
  modified_base (557)..(557): a, c, t, g, unknown or other
  misc_feature (557)..(557): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatccttccctgtctgcatcgtaggtagganacagagtaccaccatccacgttcggccgggacaaaggaccagaactagttcggcagtacttaagtttaaagttggtatcgagacaagaaaaccgagggaacctaccccctaacctccgtagtactcctatcgtcgtcgnaccgtacttacgttagactaaggtggaacctcccagtacggtagttcgaggtcggtcgtagggtcggggttacgtacgggtaactagtttacctttccgtccttacgttaccctaccgttaagttcgaccgttagtcgttaccgaaccgttaacgtaaggttaattaccgttttaggaacctttaaacctttacgtccgttatacgaaaccggtnttaaaccggtttactacgttaccgtacctagttcccttagttccggaaccgtaacgggtaccaggtactacggtaacgtaacttaacggtatcggacgtactcgacccg

SEQ ID NO: 71300 - DNA, 639 bp, Homo sapiens
  misc_feature: GYAE6OF02HY607.51.32.C10.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttcctgtctgcatctgtagganacagagtcacatcacttgccggganaagacagaacattggcagctatttaatggtatcagcaagaaaccgagggaaacncccctaaacctcctagactctatgctgctagcctatttgacctaaaggtcggtactcccaagtccggaaggtttccaaggttcggactaggtggggtctaggggactagtactttctcttctcacctaatttagactacgtcgtacgtaccaaccgttagtaaagtatttttacgaccttaaaccttttaactacgttacgttaacctaaaccgaacggttaacgtttaactaaacgttttcgaaccccgttattacccgttaccgttttaccggtacccggaaaacgggtacctaaccggtaacgtcggtaacgtaacgtttaaaccggaacgttacgggttacggtccgttacggacccg

SEQ ID NO: 71301 - DNA, 772 bp, Homo sapiens
  misc_feature: GYAE6OF02FLX23.51.32.C10.1.454.CMB.1.raw
  modified_base (105)..(105): a, c, t, g, unknown or other
  misc_feature (105)..(105): n is a, c, g, or t
  modified_base (236)..(236): a, c, t, g, unknown or other
  misc_feature (236)..(236): n is a, c, g, or t
  modified_base (507)..(507): a, c, t, g, unknown or other
  misc_feature (507)..(507): n is a, c, g, or t
tcagcgatcgtatacacgaccggtgctcgatttagtatagacatcaacacacaaagggggagtcagtctcagtcaggacacgagcatggacatgagggtccccgntcagctcctggggctcctgctactctggctccgaggtgccagatgtgacatccagatcgacccagtctccatccttccctgtctgcatctgtaggacacagacgtccaaccatccacttcgggccgggtanaaagacagaaactagttcgggactacgtactttaaagttttaaacttgggtaactacgagtacaaacggtaaaacccggtagggggtaaaaccctccccccgttaaaccctccgttaggtaacttaccgtaagtcggtacctcggaacctacgtaccccttaggtttacgaacggtaaacggttcgggaaccgttcccgtaagttaccgggtaacggtttccgaacgggttgggaccgttaacggggttacggggtcggtaaccggggtanaacgttttacgttttccctcggtttaccctacgtaacccgttagtaacgtcgtaaccgttccggtataacccgtaaacggttacggttaacgtttacgttttacgaaccttaaccgttacgttacccttaagggtaccctaaagttacggtaacgtttaaacccttattcccaaccgtacttaccgtttaccgtaccggaacggtaaccggtacacggttacgtaacgtaattaccgtaacgaccgttggaccttagtactaccg

SEQ ID NO: 71302 - DNA, 727 bp, Homo sapiens
  misc_feature: GYAE6OF02IB1FY.51.32.C10.1.454.CMB.1.raw
tcagcgatcgtatacacgaccggtgctcgatttagtatagacatcaacacacaaaggggggagtcagtctcagtcaggacacagcatggacatgagggtccccgctcagctcctggggctcctgctactctggctccgaggtgccagatgtgacatccagactgaccctagtcctaccacttccttccctgttctcgctactcgtggtaggagaacgagtacgtacacctatactaccgtcggcccgggacaaggacaagaacgtagttggacgtacgtaactttaaagttttaaagttcggtaactacgacggaactaaaccggaaaacgaaaccggggaaaacccgtaccccccttaaaccctccgtacgtacttctaagtcgtcgtacgcgacgtcctaactttggaacgtaaacggtcggtacgtacccaggttacggttaggttacgacggtaggtcgtaggggttgggtaccggtagggacttacgttacttttaccgtccttaccgtacaaccttagtacgtcgtacgtcgtacggaaccttaacgtagttaacgtttactttacgacctaaagttctacgttacgtactaaacgtagttacttaactacgttaccgaccttactccgttaccggtacggtaccggaaacggtactaccggtagtaaacggtaacgtaacggttaaacgttacggtggttaaccgaccgtagtaaccccg

SEQ ID NO: 71303 - DNA, 768 bp, Homo sapiens
  misc_feature: GYAE6OF02HZBGG.51.32.C10.1.454.CMB.1.raw
  modified_base (463)..(463): a, c, t, g, unknown or other
  misc_feature (463)..(463): n is a, c, g, or t
tcagcgatcgtatacacgaccggtgctcgatttagtatagacatcaacacacaaagggggagtcagtctcagtcaggacacagcatggacatgacgggtccccgctcagctcctggggctcctgctactcgtggctccggaggtgccagatgtgacatcagatcgaccagtctccatcttccctgtctgctatcgtagtaggagacagagtacacctataccacgttcgaccgggacaaacggacaagaactagttcggacaggtcttaaatttaaagtttggtaacttacgtagactaaacggaaaaccgaaacgggaaaccgacccccttaacctccgtaggacttacgttaacgtcgtctcgactaccgtccttagttttacgacgtaaaggttcggaacgttaccccgaagttcggtaggtttacgaggtgacggtagggtcggttaggtacgggtaanacgtttacgtttcctctaccgttcctaacgtattacggacgtagttcctagtaccgttaacgtaggttaacggttaacttttaggaaacccttaacgtttaaccttaaccggtttagtaaccgttaaacgttaagttaaccgtttaaactttacgtttaaaccgacccgttaagtttacccgttaaccgttttacccgggaaccgggtaaaccggtaacccgtaaccggtaaacgttacgggaaaacgttacgtttaaaacccggtaccggttaacggttaccgggtacgttacccggtaacccg

SEQ ID NO: 71304 - DNA, 587 bp, Homo sapiens
  misc_feature: GYAE6OF02FIJEN.51.32.C10.1.454.CMB.1.raw
  modified_base (238)..(238): a, c, t, g, unknown or other
  misc_feature (238)..(238): n is a, c, g, or t
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtcctccatcttccctgtctgcatctggtaggagacagagtcaccatcacgttgccgggcaagacagaacngttgcagtctaatttaatgtatcagcagaaaccgaggaacncccctaactcngatctancgtctgncnctagttagacgaagttcggactccatcggagttcagtgntagtgggctagggactagtatttcgtctactctaaccgtattacgctagtcctacgtaaccaaccgtagtaacgttatttacgacttaacctttacgttaacgttacgtacgaaacgtaagttaagttaactaacgtttacgacccgttacttacgttaccgttacccggtacggtaaacgggaccgaacgtacgttaggaacgtaacgttaaaccgaaggtcggttacggcgtacgtaacc

SEQ ID NO: 71305 - DNA, 667 bp, Homo sapiens
  misc_feature: GYAE6OF02HP0HV.51.32.C10.1.454.CMB.1.raw
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcacatcacttggccggcaagacagaacagttcggcaagtcttaattttaaagttggtatacgaagccaacgaaaaccgaacgggaaaccgtcccccttaaacctccgtgactactatcgcctagccacgtccctacgtttacgaacgtaaaggtcggaaccgttacccgagttcggtacggttacgagggttcggacgtaggttcgggtcgtagggacgtagttacgtttcgtccttactaccaaccgttaagttacgacgttagtaccgtacgaccttaaaccgtgtaaacgtttatttacgactttaacccttacgttacgtaccgttaacaaccgtaaggtaactttaaccttaacgttctacccgtattacccgttacgttaccgtaaccggaacggtaccgaacgtacggtaggtaaccgtaacgttaaacgtacgtggtacgtacggtatacccg

SEQ ID NO: 71306 - DNA, 854 bp, Homo sapiens
  misc_feature: GYAE6OF02HVYZN.51.32.C10.1.454.CMB.1.raw
  modified_base (104)..(104): a, c, t, g, unknown or other
  misc_feature (104)..(104): n is a, c, g, or t
  modified_base (204)..(204): a, c, t, g, unknown or other
  misc_feature (204)..(204): n is a, c, g, or t
  modified_base (242)..(242): a, c, t, g, unknown or other
  misc_feature (242)..(242): n is a, c, g, or t
tcagcgatcgtatacacgaccggtgctcgatttagtatagacatcaacacacaaagggggagtcagtctcagtcaggacacagcatggacatgagggtccccgntcagctcctggggctcctgctactctggctccggaggtgccagatgtgacatccagatcgaccagtctccattccttcctgtctgacattctagtagganacaggtacgtaccaccatccgtacttcggaccgggtanaaagacgtaagaactagtacggactagtacctttaaattttaaacgttgggtaactacgtaacggtaacccaaaacggtaaaaaacccgaacgggggtaaaaacccctaccccccgtttaaaacccgtttaccggtagtaaactttaccgttaacgtacgtaccgtacgtaccgtaacccgtaccgttaaccgtttaggaaaccggttaaaaggtccgggtaaacccgtaccccgttaaaggttacccggtttaacgggttaaccgacggggttaaccggtacggttaacggggtttcggggggtaacccttacggggggaaactttaggtttaaccttttaccgtccgtttaaccgttaccctaacgttagttaaccgacgtaacgttcccgtaggtaaccctaaacggtttcggtaaacttacgttttaacgacctttaaaccttacgttacgttaaccgtaacaaacgggttaacgttaacgttaacttaacgttaccgaacctttagtaaccttaccggttaccggtaaacggtaacgggtaaccaacggtacgggtaacgaacggttaaccttaaacggtcggtaggttaacgaccgtacggtaacc

SEQ ID NO: 71307 - DNA, 710 bp, Homo sapiens
  misc_feature: GYAE6OF02F4XSS.51.32.C10.1.454.CMB.1.raw
  modified_base (129)..(129): a, c, t, g, unknown or other
  misc_feature (129)..(129): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactntggctccgaggtgccagatgtgacatccagatgaccagtcctcatcgttcctgtctgcatctacggtagagacgagtacgtaccaccgacttactacgttacggaccgggtactaaacgaaccgaacgtaacagttcggactaacggtacttaagttttaaacgtttaggttaactccgtaggtaaccgaacggaaaaccgaacgggggtaaaccctacccccgttaacctaccgtagtactactagttcgctacgacctacgacccttattacgaaccgtaagtcggaccgtaccgtagtacggtacggttacgtacggtggtacgaggttaccgggtcgtacgggactaagggttctttactcgttactaccaccttacttagaccgttagtccgtacgtacctaccgtagttacgttatttaaccggtctaaaccgtttacttaccgtagtaacctacgtaattacgtaccttacttaccgccttacgttaccgtaccgttacgtaccggaacggaccgttacgaacgttacgtaacgttaacgtaaccggtagtaacgtcggtaccgtacgtaaccg

SEQ ID NO: 71308 - DNA, 687 bp, Homo sapiens
  misc_feature: GYAE6OF02G1D4O.51.32.C10.1.454.CMB.1.raw
  modified_base (105)..(105): a, c, t, g, unknown or other
  misc_feature (105)..(105): n is a, c, g, or t
  modified_base (144)..(144): a, c, t, g, unknown or other
  misc_feature (144)..(144): n is a, c, g, or t
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (496)..(496): a, c, t, g, unknown or other
  misc_feature (496)..(496): n is a, c, g, or t
  modified_base (675)..(675): a, c, t, g, unknown or other
  misc_feature (675)..(675): n is a, c, g, or t
tcagcgatcgtatacacgaccggtgctcgatttagtatagacatcaacacacaaaggggggagtcagtctcagtcaggacacagcatggacatgagggtccccgntcagctccgtggggctcctgctactctggctccgaggtnccagatgtgacatccagatgacccagtctccattccttccctgtctgctagtctggtagganacgaggtacgtaccaacnctacacgtcggccgggacaagactaggaactagtcggacagtactttaatttaacgtggtctagagacctaacggaaaccggagggaaaccctacccctaacgtacgtagaacttctatcggtcacgtcgaccgtactacgtttacgaacgtaaacggttcggacctaaccgtaacttacggggtacggttagtacgggtacgtacggggtagtcggggtacgtaacggggatacggggtttacttccctaccgttcttacctaaaccgttntttaacgacgttacgtcgtacgtaaccctaaacgggttattaagtttaccgttttagtacctaaacctttcgtacgttacgaactacgtaataccgttaactaccgttcacgttcctacgtacgtaccgtaccggaacggttacgacgtaacgaagtacgaaactacggtatgggtacncgtacgtacccg

SEQ ID NO: 71309 - DNA, 699 bp, Homo sapiens
  misc_feature: GYAE6OF02HI3CE.51.32.C10.1.454.CMB.1.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
  modified_base (470)..(470): a, c, t, g, unknown or other
  misc_feature (470)..(470): n is a, c, g, or t
tcagcgatcgtatacacgaccggtgctcgatttagtatagacatcaacacacaaagggggagtcagtctcagtcaggacacagcatggacatgagggtccccgctcagctcctggggctcctgctactctggctccgaggtgccagatgtgacatccagatcgacccagtctccatccttccctgtctgcatctggtaggagacgagagtacaccatcacttggccggganaagacagaacagttggacagtacttaatttaaattggtatcagacaacgaaacgaagggaacctacccctaacctacngtactctagtcgcgtgcgacggtcctacgttcgacgtaaacggtcggaacgtccgtagttacggtaggttacgtaggtcgggtactaggggttcgggtacggtaggggtactaaggtctttttccgtacctccgtttaacgaccttaacgtttagccggtntttaccgtagaaaccttaacggtaaggtaacgtttaccgtttacgaaccctttaaaccgtttattaaccggtaccgttaacgaaacggtttacgtaaactttttaacccgtaatttccccgaacccgtttaagttcccttaacccgggtttcggaacccggtaaaggtcccaaacggttccgaagggttaacaacgtttaaacggacgtggtttaacggctaaccgacg

SEQ ID NO: 71310 - DNA, 245 bp, Homo sapiens
  misc_feature: GYAE6OF01BJGDT.42.38.D05.1.454.CMB.1.raw
  modified_base (244)..(245): a, c, t, g, unknown or other
  misc_feature (244)..(245): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnn

SEQ ID NO: 71311 - DNA, 248 bp, Homo sapiens
  misc_feature: GYAE6OF01DAZOB.42.38.D05.1.454.CMB.1.raw
  modified_base (244)..(248): a, c, t, g, unknown or other
  misc_feature (244)..(248): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnn

SEQ ID NO: 71312 - DNA, 245 bp, Homo sapiens; identical to SEQ ID NO: 71310
  misc_feature: GYAE6OF01EUHBW.42.38.D05.1.454.CMB.1.raw
  modified_base (244)..(245): a, c, t, g, unknown or other
  misc_feature (244)..(245): n is a, c, g, or t

SEQ ID NO: 71313 - DNA, 248 bp, Homo sapiens
  misc_feature: GYAE6OF01BQHKC.42.38.D05.1.454.CMB.1.raw
  modified_base (243)..(248): a, c, t, g, unknown or other
  misc_feature (243)..(248): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnn

SEQ ID NO: 71314 - DNA, 245 bp, Homo sapiens
  misc_feature: GYAE6OF01ED5FH.42.38.D05.1.454.CMB.1.raw
  modified_base (243)..(245): a, c, t, g, unknown or other
  misc_feature (243)..(245): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnn

SEQ ID NO: 71315 - DNA, 245 bp, Homo sapiens; identical to SEQ ID NO: 71310
  misc_feature: GYAE6OF01EBAW3.42.38.D05.1.454.CMB.1.raw
  modified_base (244)..(245): a, c, t, g, unknown or other
  misc_feature (244)..(245): n is a, c, g, or t

SEQ ID NO: 71316 - DNA, 320 bp, Homo sapiens
  misc_feature: GYAE6OF01EW0K2.42.38.D05.1.454.CMB.1.raw
  modified_base (263)..(320): a, c, t, g, unknown or other
  misc_feature (263)..(320): n is a, c, g, or t
tcagtgacgtatgtcacgaccggtgctcgatttagtatctgatagttgggttggggagaatgggaagtcgtggacgtcctggggacagggaaacctgggtcaccgtactccgtccagcttccaccaagggcccgatcggtcttccccctggccgccctgctccgagggagcacctctgggggacacgacgcggccctgggcctgccctggtcaacggctacttccacactacgtcactggagcgggctggcaaggcgcatagnnnnnnnnnnnnnnnnnnnnnnnnnnnnnnnnnnnnnnnnnnnnnnnnnnnnnnnnnn

SEQ ID NO: 71317 - DNA, 248 bp, Homo sapiens; identical to SEQ ID NO: 71311
  misc_feature: GYAE6OF01BQNB0.42.38.D05.1.454.CMB.1.raw
  modified_base (244)..(248): a, c, t, g, unknown or other
  misc_feature (244)..(248): n is a, c, g, or t

SEQ ID NO: 71318 - DNA, 245 bp, Homo sapiens; identical to SEQ ID NO: 71314
  misc_feature: GYAE6OF01EU1U2.42.38.D05.1.454.CMB.1.raw
  modified_base (243)..(245): a, c, t, g, unknown or other
  misc_feature (243)..(245): n is a, c, g, or t

SEQ ID NO: 71319 - DNA, 246 bp, Homo sapiens
  misc_feature: GYAE6OF01CVTM8.42.38.D05.1.454.CMB.1.raw
  modified_base (244)..(246): a, c, t, g, unknown or other
  misc_feature (244)..(246): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnn

SEQ ID NO: 71320 - DNA, 274 bp, Homo sapiens
  misc_feature: GYAE6OF01B09X8.42.38.D05.1.454.CMB.1.raw
  modified_base (246)..(274): a, c, t, g, unknown or other
  misc_feature (246)..(274): n is a, c, g, or t
tcagtgacgtatgtcacgaccggtgctcgatttagtatctgatagttgggttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctcggcaaggcgcgatagnnnnnnnnnnnnnnnnnnnnnnnnnnnnn

SEQ ID NO: 71321 - DNA, 289 bp, Homo sapiens
  misc_feature: GYAE6OF01A5LXK.42.38.D05.1.454.CMB.1.raw
  modified_base (247)..(250): a, c, t, g, unknown or other
  misc_feature (247)..(250): n is a, c, g, or t
  modified_base (252)..(252): a, c, t, g, unknown or other
  misc_feature (252)..(252): n is a, c, g, or t
  modified_base (254)..(289): a, c, t, g, unknown or other
  misc_feature (254)..(289): n is a, c, g, or t
tcagtgacgtatgtcacgaccggtgctcgatttagtatctgatagttggttgggagatgggaagtcgtggactcctggggacagggaaacctggtcaccgtctcctcacgcttccaccaacgggcccatcggtcttcccctggcgccctgctccaggagcacctctgggggcacagcggccctgggcctgcctggtcaaggacctacttccacatacgtcactgagcgggctggcaaggcgcatagnnnntntnnnnnnnnnnnnnnnnnnnnnnnnnnnnnnnnnnnn

SEQ ID NO: 71322 - DNA, 285 bp, Homo sapiens
  misc_feature: GYAE6OF01EF05N.42.38.D05.1.454.CMB.1.raw
  modified_base (246)..(285): a, c, t, g, unknown or other
  misc_feature (246)..(285): n is a, c, g, or t
tcagtgacgtatgtcacgaccggtgctcgatttagtatctgatagttggtttggggagatgggaagtcgtggactcctggggacagggaaacctggtcaccgtctcctccagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnnnnnnnnnnnnnnnnnnnnnnnnnnnnnnnnnn

SEQ ID NO: 71323 - DNA, 359 bp, Homo sapiens
  misc_feature: GYAE6OF01C5CX6.42.38.D05.1.454.CMB.1.raw
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (274)..(359): a, c, t, g, unknown or other
  misc_feature (274)..(359): n is a, c, g, or t
tcagtgacgtatgtcacgaccggtgctcgattttagtatctgatagttgggtttgggagatgggaagtcgtggacctcctgggggacagggaaacctggtccaccgtctcctcagcttccaccaagggcccatcggtcttccccctggccgcctgctcccaggagcaccttctgggggcacagcggccctgggctgcctggtcaaggacgtaacttcacatacgtcactgagcgggctggcaaggcgcatagcntncngcnancngcagcaacnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 71324 - DNA, 246 bp, Homo sapiens
  misc_feature: GYAE6OF01DQQN0.42.38.D05.1.454.CMB.1.raw
  modified_base (243)..(246): a, c, t, g, unknown or other
  misc_feature (243)..(246): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnn

SEQ ID NO: 71325 - DNA, 247 bp, Homo sapiens
  misc_feature: GYAE6OF01BVDRV.42.38.D05.1.454.CMB.1.raw
  modified_base (244)..(247): a, c, t, g, unknown or other
  misc_feature (244)..(247): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnn

SEQ ID NO: 71326 - DNA, 244 bp, Homo sapiens
  misc_feature: GYAE6OF01DCSKJ.42.38.D05.1.454.CMB.1.raw
  modified_base (244)..(244): a, c, t, g, unknown or other
  misc_feature (244)..(244): n is a, c, g, or t
tcagtgacgtatgtcacgaccggtgctcgatttagtatctgatagttggtttgggagatgggaagtcgtggactcctgggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagn

SEQ ID NO: 71327 - DNA, 249 bp, Homo sapiens
  misc_feature: GYAE6OF01CXQ9K.42.38.D05.1.454.CMB.1.raw
  modified_base (244)..(249): a, c, t, g, unknown or other
  misc_feature (244)..(249): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaaggcccatcggtcttcccctggcgccctgctccaggagcacctcgtgggggcacagcggccctgggctgcctggtcaaggactacttccacatacgtcactgagcgggctggcaaggcgcatagnnnnnn

SEQ ID NO: 71328 - DNA, 515 bp, Homo sapiens
  misc_feature: GYAE6OF01EFEVN.42.38.D05.1.454.CMB.1.raw
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (413)..(413): a, c, t, g, unknown or other
  misc_feature (413)..(413): n is a, c, g, or t
  modified_base (444)..(444): a, c, t, g, unknown or other
  misc_feature (444)..(444): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggggcacgttatgatgttcactggtatcagcaacttccaggaacagccccaagctcctcatctatggtaataataatcggccctcaggggtccctgaccgattctctgtctccaggtctggcacctcacgccctcctggccatcactgggctccgngttgagntgnggctgactatcattgtcacgtcccatcgacngtcggcctagtggtacgggtttcgggcgggggtaccaaggcgtcggaccgtcgtaggccgtcgcggacccg

SEQ ID NO: 71329 - DNA, 245 bp, Homo sapiens; identical to SEQ ID NO: 71314
  misc_feature: GYAE6OF01A6S76.42.38.D05.1.454.CMB.1.raw
  modified_base (243)..(245): a, c, t, g, unknown or other
  misc_feature (243)..(245): n is a, c, g, or t

SEQ ID NO: 71330 - DNA, 251 bp, Homo sapiens
  misc_feature: GYAE6OF01BS2H4.42.38.D05.1.454.CMB.1.raw
  modified_base (243)..(251): a, c, t, g, unknown or other
  misc_feature (243)..(251): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnnnn

SEQ ID NO: 71331 - DNA, 249 bp, Homo sapiens
  misc_feature: GYAE6OF01ED3OW.42.38.D05.1.454.CMB.1.raw
  modified_base (244)..(249): a, c, t, g, unknown or other
  misc_feature (244)..(249): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnn

SEQ ID NO: 71332 - DNA, 247 bp, Homo sapiens
  misc_feature: GYAE6OF01EDJ65.42.38.D05.1.454.CMB.1.raw
  modified_base (244)..(247): a, c, t, g, unknown or other
  misc_feature (244)..(247): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatagtcactgagcgggctggcaaggcgcatagnnnn

SEQ ID NO: 71333 - DNA, 246 bp, Homo sapiens; identical to SEQ ID NO: 71324
  misc_feature: GYAE6OF01CW2D4.42.38.D05.1.454.CMB.1.raw
  modified_base (243)..(246): a, c, t, g, unknown or other
  misc_feature (243)..(246): n is a, c, g, or t

SEQ ID NO: 71334 - DNA, 247 bp, Homo sapiens
  misc_feature: GYAE6OF01BGX8O.42.38.D05.1.454.CMB.1.raw
  modified_base (244)..(247): a, c, t, g, unknown or other
  misc_feature (244)..(247): n is a, c, g, or t
tcagtgacgtatgtcacgaccggtgctcgatttagtatctgatagttgggttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnn

SEQ ID NO: 71335 - DNA, 509 bp, Homo sapiens
  misc_feature: GYAE6OF01DNUL3.42.38.D05.1.454.CMB.1.raw
  modified_base (420)..(420): a, c, t, g, unknown or other
  misc_feature (420)..(420): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggggcacgttatgatgttcactggtatcagcaacttccaggaacagcccccaagctcctcatctatggtaataataatcggccctcacggggtccctgaccgtattctctgtctccaggtctggcacctcacgccctccctggcccatcactcgggctccgagttgaggatgngctgactatcattgtcagtccatgacagtgcctacgtggtacgggtttcggcgggggtaccaggctcgtaccgtctgcgtcgcgacccg

SEQ ID NO: 71336 - DNA, 249 bp, Homo sapiens
  misc_feature: GYAE6OF01DY79S.42.38.D05.1.454.CMB.1.raw
  modified_base (245)..(249): a, c, t, g, unknown or other
  misc_feature (245)..(249): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnn

SEQ ID NO: 71337 - DNA, 249 bp, Homo sapiens
  misc_feature: GYAE6OF01DXBP3.42.38.D05.1.454.CMB.1.raw
  modified_base (243)..(249): a, c, t, g, unknown or other
  misc_feature (243)..(249): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctggcaaggcgcatagnnnnnnn

SEQ ID NO: 71338 - DNA, 249 bp, Homo sapiens; identical to SEQ ID NO: 71331
  misc_feature: GYAE6OF01D78AG.42.38.D05.1.454.CMB.1.raw
  modified_base (244)..(249): a, c, t, g, unknown or other
  misc_feature (244)..(249): n is a, c, g, or t

SEQ ID NO: 71339 - DNA, 249 bp, Homo sapiens
  misc_feature: GYAE6OF01DLRUU.42.38.D05.1.454.CMB.1.raw
  modified_base (245)..(249): a, c, t, g, unknown or other
  misc_feature (245)..(249): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttcccctggcgccctgctccaggagcacctctgggggcacagcggccctgggctgcctggtcaaggactacttccacatacgtcactgagcgggctgggcaaggcgcatagnnnnn

SEQ ID NO: 71340 - DNA, 633 bp, Homo sapiens
  misc_feature: GYAE6OF01BDEYB.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcacgtgggaactaatttcaacagtcggggctacgttatgatgttcacgtggtatcagcaacttccgaggaaccacgccccaagcctcctcatctatagtaataataactccgcctcgacgggtccctcgaccgtattctctcgtcctccgtaggtcctcggcctaccgtcgaccgtccccttcccgtcggaccctacgtccgtacggttcgggtccttccggtaggtttcggaggtacgtcggacggtctacgtacttatcgtacgttcgtactacgtcccagtacgtacgtacggtcggtaccgttacggttggggttaccggggttttaccggggaccggggggtaaccctaacgggtccgtacgggtacccggtccgtacggcccggtccgaccggtaaccccgg

SEQ ID NO: 71341 - DNA, 259 bp, Homo sapiens
  misc_feature: GYAE6OF01BZ72M.42.38.D05.1.454.CMB.1.raw
  modified_base (245)..(259): a, c, t, g, unknown or other
  misc_feature (245)..(259): n is a, c, g, or t
tcagtgacgtatgtcacgaccggtgctcgatttagtatctgatagttgggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnnnnnnnnnn

SEQ ID NO: 71342 - DNA, 249 bp, Homo sapiens
  misc_feature: GYAE6OF01DO75R.42.38.D05.1.454.CMB.1.raw
  modified_base (245)..(249): a, c, t, g, unknown or other
  misc_feature (245)..(249): n is a, c, g, or t
tcagtgacgtatgtcacgaccggtgctcgatttagtatctgatagttgggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnn

SEQ ID NO: 71343 - DNA, 245 bp, Homo sapiens
  misc_feature: GYAE6OF01BPZEI.42.38.D05.1.454.CMB.1.raw
  modified_base (244)..(245): a, c, t, g, unknown or other
  misc_feature (244)..(245): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcggctggcaaggcgcatagnn

SEQ ID NO: 71344 - DNA, 251 bp, Homo sapiens; identical to SEQ ID NO: 71330
  misc_feature: GYAE6OF01EBV1H.42.38.D05.1.454.CMB.1.raw
  modified_base (243)..(251): a, c, t, g, unknown or other
  misc_feature (243)..(251): n is a, c, g, or t

SEQ ID NO: 71345 - DNA, 850 bp, Homo sapiens
  misc_feature: GYAE6OF01EBRCC.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgacgggtccgtcgggcccagtctgtactgaccgcacgcccgtcctcgaggtcggtccggtccggggaccccgagggcgacggacgggtaccaacctacttcctccgtcgaccgtacgtacgggaaactaactttaccgaacgtacggtacgggtacgtacgttagtagtagttcgttacgtacgttaggtactacgtacgtacctaaccgtaccgaacggaaccgaccgaccccgaaccgtacctacctactactacttaacgttaagttaaactaacgtaacgttaccggtacccgtaccggtaccgggtacccgtaccggtaccgtacgttaccgttccgttcgttaccgttaccggttacggttccggaccggttttttttttttttttttttttttttttttacccgacccgttacccgtacccgttacccgttcccgtaccggtaccgtaccgtaccgtaccggtccgggtaccggttaccggttacggttacggtacggtacggtacggtacggtacgtacgtacgttacgtacgttacgttacgtaccgtaccgtaccgtacgtacgtacggtacggtacgtaccgttacggttacggggttacggggttaccggggtaccggggtaccggtaaccggtaccggttacccggttacccggtaccggtaccggtaccggtaccgtaccggtacccgg

SEQ ID NO: 71346 - DNA, 619 bp, Homo sapiens
  misc_feature: GYAE6OF01BGGPM.42.38.D05.1.454.CMB.1.raw
  modified_base (382)..(382): a, c, t, g, unknown or other
  misc_feature (382)..(382): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctggtactgacgcacgccgccctcagtgtctcggggccccagggcagagggtcaccatctcctgcacgtgggaacaatttcaacagtcggggcacgttatgatgttcacgtggtatcagcaaccttccaggaacacgaccccaagcctcctcatctatagtaatatactcgcctcgacgggtccctcgacgtacttctctgtcctccgtaggtctgcncctcacgtccctccgtcgccatcctacgtcgggcctccggtagttcggaggtagtcggacggtctagtacgtattactagttcgtcgtaccgtacccagttacgaacgtcggtaccggtacccgttacggttcggggttaacgggggttttccgggggacccggggggtacctaaacgggtcccgttacgggtaccccggttccggtacggccggttaccgaccggtaacccccggg

SEQ ID NO: 71347 - DNA, 249 bp, Homo sapiens; identical to SEQ ID NO: 71336
  misc_feature: GYAE6OF01AIRHE.42.38.D05.1.454.CMB.1.raw
  modified_base (245)..(249): a, c, t, g, unknown or other
  misc_feature (245)..(249): n is a, c, g, or t

SEQ ID NO: 71348 - DNA, 637 bp, Homo sapiens
  misc_feature: GYAE6OF01EPT59.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtcctcggggccccagggcagagggtcaccatcctcctgcacgtgggaactaatttcaacatcggggcacgttatgatgtcactggtatcagctaacttccaggaaccacggcccccaagctcctcatctataggtaataataactccgccctacgacgggtccctgaccgtattcctctcgttcctccgacggtctcggcctacctcgacgtccctccgtcggcctactcacgtcgggccttccgtagttgacggattcggaggtctagactaagtccgtaatttcggtactcgttaccccgtaagtcgaacctacgggttccggtacccgttaacggttcggggttaacggggggtttttcccggggaccgggggggtaaccctaaacgggtccgttaaccgggtaccccgttccgtacggtcccggttccgaccgggtaccccgg

SEQ ID NO: 71349 - DNA, 247 bp, Homo sapiens
  misc_feature: GYAE6OF01E58DB.42.38.D05.1.454.CMB.1.raw
  modified_base (245)..(247): a, c, t, g, unknown or other
  misc_feature (245)..(247): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnn

SEQ ID NO: 71350 - DNA, 584 bp, Homo sapiens
  misc_feature: GYAE6OF01A9AO6.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggagcacgttatgatgttcactggtatcagcaacttcaggaacacgccccaagctcctcatctatggtaataataatcggcctcgacggggtccctgaccgtattctctcgtctcgagtctcggcacctcacgtcctcccgtcggcccactccgacgtcgggccttccgaggttgaggtagtggacggtctggtaactacgtctacgtttcgtctacgtccccagttcgaacgtacggttcggaccgttacgtagggttacggggttttccgggggaccggggggtaacccgaaggtccgttacggacccgttcccgtcggccgttccggaacccgg

SEQ ID NO: 71351 - DNA, 247 bp, Homo sapiens
  misc_feature: GYAE6OF01BJCUE.42.38.D05.1.454.CMB.1.raw
  modified_base (243)..(247): a, c, t, g, unknown or other
  misc_feature (243)..(247): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacaacgtcactgagcgggctggcaaggcgcatagnnnnn

SEQ ID NO: 71352 - DNA, 780 bp, Homo sapiens
  misc_feature: GYAE6OF01ELYNA.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacacgggtcctcgggcccagtctgtactgacgcacgccgccctcagtcgtccgtcggggcccgagggcaggacgggtccacctatcctccgtcgctacgtacgggaactaactttacaacgtagtccgggggactaacggtttatggtactttcggttactacgttcggtactcgaacgtactaaccgttaccgaacggaaccaccgaccccaacgtccttacctactacttacgttaacgttacggttaaattaaacttaccggtaccggtacccgttacgggtaccggggttccctacggaaccgtttacgttccgttcgttacgttccgtaccgtacggttccgtcggtacctacccttcgaccgtccccttccgtcggtcctacgttccgacggttcgggtacctacgggtagtcggaacggtacgtcggacggttctacggtacttacgttacgtacgtttacgtaccgtaccgttaccgtaagtacggtaacgttacgggttaccggtaccgtttaacgggttcgggggtttaaccggggggtttaccggggaaccgggggttaaccaccgggttccggttaccgggtacccggtttccgacggtacccggtacggacccgtacccggg

SEQ ID NO: 71353 - DNA, 317 bp, Homo sapiens
  misc_feature: GYAE6OF01D3SWJ.42.38.D05.1.454.CMB.1.raw
  modified_base (241)..(241): a, c, t, g, unknown or other
  misc_feature (241)..(241): n is a, c, g, or t
  modified_base (248)..(250): a, c, t, g, unknown or other
  misc_feature (248)..(250): n is a, c, g, or t
  modified_base (252)..(255): a, c, t, g, unknown or other
  misc_feature (252)..(255): n is a, c, g, or t
  modified_base (258)..(317): a, c, t, g, unknown or other
  misc_feature (258)..(317): n is a, c, g, or t
tcagtgacgtatgtcacgaccggtgctcgatttagtatctgataggttggttggggagatgggaagtcggtggactcctgggggacagggaaaccctggtcaccgtctcctcagccttccaccaaggccctatcggtcttccccctgcgccctgctccaggagcaccgtctgggggcacagcggcctggctgcctggtcaaggctacttccacatacgtcactgagcgggctggcaaggcncaatagnnntnnnnaannnnnnnnnnnnnnnnnnnnnnnnnnnnnnnnnnnnnnnnnnnnnnnnnnnnnnnnnnnn

SEQ ID NO: 71354 - DNA, 929 bp, Homo sapiens
  misc_feature: GYAE6OF01BVMFH.42.38.D05.1.454.CMB.1.raw
tcagtgacgtatgtcacgaccggtgctcgatttagtatctgataggttggggtttgggggcttcagctgtgggcacaagaggcagcactcaggacaagctccagcatggcctggtctcctctcctcctcactctcctcgctcactgcacgacgggtccgtcgggccctagtctgtactggacgcgacgcccgcctcgaggttcggtccggtccgggggccccgaagggcgaagggacgggtaccacctacgttccctccgtcgaccgtaacggttaacggggtaaaaccttaacgtttaccgaaaaccggtacggggttcccgggggtaacgttacggtttaagtacggttaacgtttcggttaccggtaacggttagggtaacttaccggtaacccggtaaccttaaacccgtttaaccggaaaccgggtaaacccgtaaaccccggtaccccctaaacggttcccctttaaccctaacgttaacttacccggtttaaaggtttaaacggttaaaagttaacccgttaacggtccccgggtaacccgttaccggggtaacccggggtttcccgaacggttaaccctttaccgtttccgtaccgtttccggtaccttaccgggttaacgttccgtaccggacctacccgttaccgtacccggttccccgttaccgtacggtacccttaacgtaccggtaccgggtcggttaccgtccggtaaggttacgggacgtacggtgggtaacgtccgtaagttaacctagtaccgttactacgtaccgtactaccgtagggttacaccgaggttccgtaaccggttaggggttcggggttaccgggggttaaccgggggaaccgggtacctacggggtccgttacccggggtacccttgggtaccgacccggttaccggaacccggtcccgggg

SEQ ID NO: 71355 - DNA, 249 bp, Homo sapiens
  misc_feature: GYAE6OF01BYSOY.42.38.D05.1.454.CMB.1.raw
  modified_base (244)..(249): a, c, t, g, unknown or other
  misc_feature (244)..(249): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaaggcccatcggtcttccccctggcgccctgctccaggagcacctctgggggcacagcggccctgggctgcctggtcaaggactacttccacatacgtcactgagcgggctggcaaggcgcatagnnnnnn

SEQ ID NO: 71356 - DNA, 708 bp, Homo sapiens
  misc_feature: GYAE6OF01E2IN5.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgacgggtccgtcgggccctagttcttgtactgaccgcacgcccgccctcagtcgtcgtcggggccccgagggcgaggacgggtccaccacttcctccgtcgccgtacggtacgggtaaacctaacttttaccaaacgtacggtcggggtactaacgtttatacgtagttcgttacacgttaggtactacgaacgtacctaaccgttaccgaacgaaccgacccgtaccccaacgtcctcctactacttactagtaagtaataactacgtccgccgtacgtacggtcctacgtaccgtacttctctcgtccgtcgtacgtccgtcgacctaccgtcacccgtccctccgcgtacctacgtccgtcggtcggtcgtacggtagtagggacgtacgtgaacggtctaggtactacgtacgtacgttccgtaacgcctaccgagtccggaagtcggtacgtaccgttacggggttcggggttaccgggggttaccggggaaccgggtacctacgggtacccgttccggaccggttccgaccgtaccgtaccgcccgggtaccccg

SEQ ID NO: 71357 - DNA, 255 bp, Homo sapiens
  misc_feature: GYAE6OF01CL8TZ.42.38.D05.1.454.CMB.1.raw
  modified_base (248)..(255): a, c, t, g, unknown or other
  misc_feature (248)..(255): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttcccctggcgccctgctccaggagcacctcgtgggggcacgaggcggccctgggctgcctagtcaaggactacttccacatacgtcactgaggcgggctggcaaggcgcatagnnnnnnnn

SEQ ID NO: 71358 - DNA, 616 bp, Homo sapiens
  misc_feature: GYAE6OF01EHOO9.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacacgggtcctgggcccagtctgtactgacgcagccgccctcagtgtcgtcggggccccagggcaggagggtcaccatctcctgcacgtagggaactaatttcaacagtcggggactacgttatggatgttcactggtatcagactaacttccgaaggtaaccaccgaccccaagcctcctctatctataggtaataataactccggcctcgacgggtccctcgaccgtattctctcgtctacgtggtctcgcacctcacgtccctccgtcgccctactcgtacgtcgggtactccgtagttcgaggtcgtaggacgtcgtcacgttactacgttagttcgtcctaacgtccgtagtacgtaccgaggttccggtaccgttaggttcgggttacggggttttccggggaacgggggtaccgtaacggtcgtaccggtaccgttaccggtacggtccgtcgacgtaccccgg

SEQ ID NO: 71359 - DNA, 718 bp, Homo sapiens
  misc_feature: GYAE6OF01AXHZ4.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgagggtcctgggcccagtctgtactgacgcacgcccgccctcagtcgtcgtcggggccccgagggcaggacgggtaccaccacttcctcctgacctacgtaggaaactattacaacgtaggtcgggactacgttatgtattcgtactacgtagtactcgacgtacctaacgttaccgaacggtaaccgaccgaccccgaagtccctacctactacgtactacgtaagtaaactaacgtaccgtaccggtacctacggtaccggtcctacgacgtacttcctcgtacgtccgtacgtacgtcgtaccgacctaccgtaccgtaccgttccccgtaccgtcgtaaccctaccgtaccggttacggtccgggtaccttacgggtaggttaacgggcgtaagtcgggtaccgtacgttaacctacgttaaccgtcgttacgttaccgtacttacccggtacaaggtaccgaacggttccgtcggttaccgtcggggttacggggttccgggggttacgggaccggtactacggtcgttacccgcgttccggacgtccgtaccggaccgtacccgg

SEQ ID NO: 71360 - DNA, 883 bp, Homo sapiens
  misc_feature: GYAE6OF01EVPII.42.38.D05.1.454.CMB.1.raw
  modified_base (836)..(836): a, c, t, g, unknown or other
  misc_feature (836)..(836): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactcctcctcgctcactgcacgacgggtcctcgggccagtctgtactgacgcacgcccgcctcgagtcggtccggtccggggccccgaggggcaggacgggtccaacctacgttcctccgtcgaccgtaacgtacgggtaaacctaacgtttacgaaaccgtacggtccgggggtaccttacggttagtagtacgtttcgtaccgtaacgttacgggttactaccggtaacgtaccgttaaacccgttaccggaaacgggtaaacccgaccccggaacccccctaaacggtccccttaccctaccgtaacgttaccgttaaaggtttaacggttaaaactttaaaacggttaacccggtccccgggtaccccgttaccggggttaacccgggggtcccccgttaacggtaacccggtttctttaccggtccgttaccggttacccgttaccggtacgggttccgttaccggaccctaaccgtcccgtacccggttcccctaccgggtacggtacccctacgttacccggtaacggtccggggttacccgtaaccggtttagggtaccggaaggtccgtaggacgtacttacgtactttacgggtactacgtttacggaccttaccgtaccagttaccggaagttccgggttaccttaccggttaggggttccgggggtttaccggggttccgggggaaccgggtaaccngggttaccgtccgtacccgtggtaccgtccggacgtcccgggtaccg

SEQ ID NO: 71361 - DNA, 249 bp, Homo sapiens
  misc_feature: GYAE6OF01ESUTT.42.38.D05.1.454.CMB.1.raw
  modified_base (243)..(249): a, c, t, g, unknown or other
  misc_feature (243)..(249): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaagcgcatagnnnnnnn

SEQ ID NO: 71362 - DNA, 842 bp, Homo sapiens
  misc_feature: GYAE6OF01C4II2.42.38.D05.1.454.CMB.1.raw
  modified_base (174)..(174): a, c, t, g, unknown or other
  misc_feature (174)..(174): n is a, c, g, or t
  modified_base (191)..(191): a, c, t, g, unknown or other
  misc_feature (191)..(191): n is a, c, g, or t
  modified_base (279)..(279): a, c, t, g, unknown or other
  misc_feature (279)..(279): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctctcactctcctcgctcactgcacgacgggtcctcgggcccagtctgttacnggacgcacgccgccctnagtcgtcgtcggggccccagggcgaggtacggtcaccatcctcctgacacgtaggaactatttaccaatacggtcgggactacgttangattgttacagtggtatcacgcctaacgtccaaggacccaccgtaccccaagtccctcctagacttcgtaaacgttaggtaaactaacgtacgtccggtcccgttacggaaccgggttcccacggtaccgttacttccgtcgttccgtcgttaccggtcggtacgttccgggaccctaccgtacctacccggtccccgtttccggaacggttccctaacgtccgggttaaccgtcggggtacccttacggggtagtttaaccggggaaggttacgtcgggtaaccggtttactacgttaacgttcttaacggttaacgtttccggaaccgttaccgtacccgttaacggttggtaaaccggttaaccgggttccggtaacccgggttttaccggggtttaacgggggggtttaacccggggggggttttaccccggggggaaacccggggggttaaaccttccgggggtttaacccgttacccgggggttaccccccggttaaaccggggtttcccgggttaaaaaccccgtcccgggggtaacccccggtaaacccccgggg

SEQ ID NO: 71363 - DNA, 302 bp, Homo sapiens
  misc_feature: GYAE6OF01DOWU6.42.38.D05.1.454.CMB.1.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (250)..(302): a, c, t, g, unknown or other
  misc_feature (250)..(302): n is a, c, g, or t
tcagtgacgtatgtcacgaccggtgctcgatttagtatctgataggttggtgggagatgggagtcgtggactccgtggggacagggaaacctggtcaccgtctcctcagcttccaccaggcccatcggtctcccctggcgcctgctccgaggagcacctcgtgggggcacgagcggcccgtgggctgcctggtcaggcttactccanatacgtcactgaggcggcgtaggaccgaaggcgacaagtgngnnnnnnnnnnnnnnnnnnnnnnnnnnnnnnnnnnnnnnnnnnnnnnnnnnnnn

SEQ ID NO: 71364 - DNA, 803 bp, Homo sapiens
  misc_feature: GYAE6OF01ETI3G.42.38.D05.1.454.CMB.1.raw
  modified_base (559)..(559): a, c, t, g, unknown or other
  misc_feature (559)..(559): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctctcactctcctcgctcactgcacagggtcctgggcccagtctgtactgacgcagcccgcctcagtgtccgtcggggcccctaagggcaggacgggtccaccgtatcctccgtgaccacgtacgggaactaactttccgaaaacgagttccgggggacctaacggtttaactggacttggttaccaacgttcggtaactacgaacggtacctaaacttaccgaacgggtaaacaccggacccccgaaaggtcctaccgttacaacttacgtaactaaggttaaactaaacttaacgtccggacccttcggtacggggtccctacgacccgtattccgtcgttcgtacctaccgtaggtctacggccctaacctcgaccggtccctccgtaggcccttagcctacggtggtaccctaccgtaggttacggaaacggtntacggtacggtaccttacgggtaacctttacgtacctaaagttttccgggtaacccttacggttaaccccgtaaggttaacccgtaccggtaacggttccggtacccttaaaccggggtttggggttaaacccgggggggttttcccggggaacggggggtaaacccctaacggggttcccggttaaccggtccccggttcccggtagttaccccggaccgggtaacccgtaaacccccggggg

SEQ ID NO: 71365 - DNA, 693 bp, Homo sapiens
  misc_feature: GYAE6OF01EU23J.42.38.D05.1.454.CMB.1.raw
  modified_base (206)..(206): a, c, t, g, unknown or other
  misc_feature (206)..(206): n is a, c, g, or t
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctctcactctcctcgctcactgcacagggtcctcgggcccagtctgtactgacgcacgcccgcctcagtcgtcgtcgggaccccngggcaggaggtccaccactctcctgacacgtggaactattacacngtcgggactacgttangtacttgtacactaggtatcgaacgtctaaccgtacggaacggaacctaccgaccccgaatccctactactacttacttaagttaacgttaaataacgttacgtccggtacctacggacgggtcctacgcctattcctcgtcgtcctacgtcggtctggtaccctactccgtccggtccctcccgtacggacctaccgtccgtaaccgtcgggtaccacccgggttaggtcgggtaacgcgttaacggcggttaccagttaccttaggttaccctaagtttccgtacgtaccgtacagttagtacccggtggtaccggtttaccgtagggtttaacgggggtttcccggggttaccggggaacggtactacgggtccgttacccgggtaccttaccggccggttaccggtccgcggtaaccccggg

SEQ ID NO: 71366 - DNA, 725 bp, Homo sapiens
  misc_feature: GYAE6OF01B4SIS.42.38.D05.1.454.CMB.1.raw
  modified_base (187)..(187): a, c, t, g, unknown or other
  misc_feature (187)..(187): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (285)..(285): a, c, t, g, unknown or other
  misc_feature (285)..(285): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctcgggcccagtctgtactgacgcagccgccctncgtgtcgtcgggccccgaggcaggaggtcaccatcctcngcncgtaggaactattcgaacgacgtcgggctacgttatgattgtacacgttggtactnacgtacctaacttaccgaacggaaccacccgtacccccgaagtacctaccctcaacgtttacgttaaacgttaaggttaaaacttaaagttaacgtcccgggtacccttacgggaccggggttacccctaacggtaccgtactttcgttaaccgtcgtacccgttccgtacggttctacgggactacccgttaaccgccgtacccgtccccgtcggtaccctacgtaccgtacggtccgggaccgttacgggtacggtgaacggtcgtacggacgtacgtacgtaacgtctcgttaagttcctaacgcgttaccctaagtccgtaacggttcggtaccgtaccggttacggtcggggttttaccggggttaggggaccgggggtaaaccctaggtcccggttacgaccgttaccgtacggccggtaaccgcggtacccgg

SEQ ID NO: 71367 - DNA, 846 bp, Homo sapiens
  misc_feature: GYAE6OF01CXMFY.42.38.D05.1.454.CMB.1.raw
  modified_base (262)..(262): a, c, t, g, unknown or other
  misc_feature (262)..(262): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgacgggtcctcgggcccagtctgtactgacgcacgcccgccctcagtcgtcgtcggggccccagggcgagacgggtccacctatcctcctcgcacgtaggaacctatttcaacgngtcgggctacgttatgtattcgttcgacgtgtactcacgtcctaacgttccgaaggacccgacgccccaagtcctcctctatacgtagtacgtaaacttaagtaaccgtccgtacccgttacggacggggttaccctggtaccttacgttccttacggtcgtccgttacccggtaggtaccgttcggaccctaccgtaccgtaccgtcccccggttacccgtaccggtaccccgacgttaccggaccggttcggggtacccgtttacgggtacggtttacgggaacgggtacgtacggggtttacccggtacggttaaccggttaaccgtttaacccgtacctttacggtttaacccgggtacctttaacccgttacccggttaacggttcgaaccgggtttacggttcccgggtaacccggttttacggggttaaccggggggtttttaacccggggggtttacccggggggttaaaccccggggtaaccggttacccggggttacccggtaccccgggtttaccccgggttaacccgggtttccggtaacccggtcccggtaaccccgggttaaccccgggg

SEQ ID NO: 71368 - DNA, 794 bp, Homo sapiens
  misc_feature: GYAE6OF01ESEET.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgtcgcccagtctgtactgacgcacgccgccctcagtcgtcgcggggccccagggccaggacgggtccacctattcctcctgcgtacggtagggtaactaattttaccgaacgacggtccggggactacgttatacgtagttcgttacaacgttaggttactaaccgtacgaccttaaacgttacccgaaacgggtaacccacccggaccccctaagtcccttacccttactacttagttaaggttaacgtaaaacttaagtaccgtccgtacccgttacgggtaccgggttccctacggtaccgtacgtttccgtactcggttaccctccgtacggttccgtcgacccttacctaccgtacccggtccccttcccggacggtaccctactccggtaacgtccggaccgttacggtacgttaggacgtgtacggacggtacctaggtacttactaccgtagtttccggaccttacccggtcgtacggtaacggtccttaagggttcccggtaaccgttagggggtttaccggggtttaccggggggttacccggggtaaaccgggggaaccttaccgggttacccgtacccgggtttacccggtaccggtaccgggtaccccgttgggaaaccccccggg

SEQ ID NO: 71369 - DNA, 804 bp, Homo sapiens
  misc_feature: GYAE6OF01AK5ZN.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgagggtcctcgggccctagtctgtactgaccgcacgccgccctcagtgtcgtcggggcccgagggcaggacgggtccaccatcctcctcgaccacgtacgggaaactactttacaacacggtccggggctaacgttagtgtagttcgttacacgttaggtactaccgacgacctaaccgtaccgaacggaaccacccgaccccgtacgacctcctactactactaagttaggtaaacttaacgtaacgtcccggtacccgtacgggtaccggggtccctacgaccgttactttacgtccgttcgttcccgtcccggttacggtccgtcggtacccctaccgtccgacccggtcccccttcggtaccgtaccacgtaccgtacgggtcggtccgtaccggttaggttaggacggtgtacgggtacggtctaaccggtactttcgtcttaacggttccttacccggtaacccttacccggtaagttaccggaacggttccccgggttggtaaacccccggtttaggggttaccgggggggttttaacccgggggttcccgggggggaaaccccggggtaattacccggggtcccggttaacccgggtacccggggtttcccgaggtaccccgggttaccggacccggtaaccccccggg

SEQ ID NO: 71370 - DNA, 721 bp, Homo sapiens
  misc_feature: GYAE6OF01BM6CR.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacaggtcctgggcccagtctgtactgacgcacgccgccctcagtgtcgtcggggccccagggcaggagggtccaccactcctcctgctacgtaggaactaatttcaacgcgtcgggactacgttatgtattcgttcacgtggtatcgagtacctaaccgttccgaacggaccaccgaccccaacgtcctacctactacttactagttaaggttaaataacgttaccgtaccggcccgttacggaccgggtccctacgaccgtacttctcgtcgtcgtaccgtacgttcgtcgtacctacctacgacccgtcccgttcccggtacgtccctacgttaccgtaaccggttcgggtacccttacgggtacgttacgggacggtaacgttcgggacggttacgtacgtaacttacgttacttcggttacgtaccgtaccgttaccgagtaccggtacgtcggttaccggtaccgttaagggtttccgggggttaggggttcccgggggaaccggggttaccgacggttcccgttaccgggtaaccttcccggacgtccggtaaccggtcggtaaccccgg

SEQ ID NO: 71371 - DNA, 776 bp, Homo sapiens
  misc_feature: GYAE6OF01EIHUA.42.38.D05.1.454.CMB.1.raw
  modified_base (520)..(520): a, c, t, g, unknown or other
  misc_feature (520)..(520): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgtagggtccgtgggcccagtctgtactgacgcacgcccgccctcaggttcgtccggtccgggggacccccgaggggccgaaggtaccgggtaccacctacgttcctaccttcgacctacggtagggtaaacctaactttacaaaccgtggtaccgggactacgttagtgtacttcggttacacgttgtactcacgtactaacctaccgaacggtaaacccaccggaccccctacgtccctccctacgtaacttacgtaagtaacggttaaaactaaggttaacccgtcccggtaccgtttaccgggaccggggtttaccctacggtaccttactttcgtaccgttcgtaccgtcgtacggtaccgcgtacccncctacgacccttcccgtaccgtcgtaccctacgttccgaccggttcgggtaccgtcgggtagtacggacgtagcgggtagtaccgtagtaactctacggttacttcgtacttccgtaccctagaccggtaaccgtggtccggttaacgtacggggtttcggggttacccggggttaccgggggaacggggtaccttacgggtaccggttaccccggtcggttacccgccgggtacccgtcggcccgggtaacccgg

SEQ ID NO: 71372 - DNA, 242 bp, Homo sapiens
  misc_feature: GYAE6OF02IQCHH.42.38.D05.1.454.CMB.1.raw
  modified_base (241)..(242): a, c, t, g, unknown or other
  misc_feature (241)..(242): n is a, c, g, or t
tcagtgacgtatgtcacgaccggtgctcgatttagtatctgatagttggttgggagatgggaagtcgtggactcctgggacagggaaacctggtcaccgtctcctcagcttccaccaagggcccatcggtcttcccctggcgccctgctccaggagcacctctgggggcacagcggcctgggctgcctggtcaaggactacttccacatacgtcactgagcgggctggcaaggcgcatagnn

SEQ ID NO: 71373 - DNA, 160 bp, Homo sapiens
  misc_feature: GYAE6OF02GE9YS.42.38.D05.1.454.CMB.1.raw
  modified_base (159)..(160): a, c, t, g, unknown or other
  misc_feature (159)..(160): n is a, c, g, or t
tcagtgacgtatgtcacgaccggtgctcgatttagtatctgatagttgggtttggggaggtgtgtcacaagatttgggctctgggcacagcggccctgggctgcctggtcaaggactacttccacatacgtcactgagcgggctggcaaggcgcatagnn

SEQ ID NO: 71374 - DNA, 249 bp, Homo sapiens; identical to SEQ ID NO: 71342
  misc_feature: GYAE6OF02IGPBZ.42.38.D05.1.454.CMB.1.raw
  modified_base (245)..(249): a, c, t, g, unknown or other
  misc_feature (245)..(249): n is a, c, g, or t

SEQ ID NO: 71375 - DNA, 247 bp, Homo sapiens; identical to SEQ ID NO: 71349
  misc_feature: GYAE6OF02JCHF5.42.38.D05.1.454.CMB.1.raw
  modified_base (245)..(247): a, c, t, g, unknown or other
  misc_feature (245)..(247): n is a, c, g, or t

SEQ ID NO: 71376 - DNA, 248 bp, Homo sapiens
  misc_feature: GYAE6OF02F5C1N.42.38.D05.1.454.CMB.1.raw
  modified_base (245)..(248): a, c, t, g, unknown or other
  misc_feature (245)..(248): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnn

SEQ ID NO: 71377 - DNA, 248 bp, Homo sapiens; identical to SEQ ID NO: 71311
  misc_feature: GYAE6OF02IZFSQ.42.38.D05.1.454.CMB.1.raw
  modified_base (244)..(248): a, c, t, g, unknown or other
  misc_feature (244)..(248): n is a, c, g, or t

SEQ ID NO: 71378 - DNA, 524 bp, Homo sapiens
  misc_feature: GYAE6OF02GGRXH.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggggcacgttatgatgttcactggtatcagcaacttccaggaacagcccccaagctcctcatctatggtaataataatcggcctcaggggtccctgaccgattctctgtctccaggtctggcacctcagccctccctggccatcactcgggcctccgagttgaggatggagctggactatcattgtcagtcccatcgacagtggcctacgtcggtacggggttttcggcggggggtaccaaggcgtcggacccgtccgtggccgtcgacgtacccgg

SEQ ID NO: 71379 - DNA, 160 bp, Homo sapiens
  misc_feature: GYAE6OF02IBXAW.42.38.D05.1.454.CMB.1.raw
  modified_base (158)..(160): a, c, t, g, unknown or other
  misc_feature (158)..(160): n is a, c, g, or t
tcagtgacgtatgtcacgaccggtgctcgatttagtatctgatagttgggtttggggaggtgtgtcacaagatttgggctctgggcacagcggccctgggctgcctggtcaaggactacttccacatacgtcactgagcggctggcaaggcgcatagnnn

SEQ ID NO: 71380 - DNA, 279 bp, Homo sapiens
  misc_feature: GYAE6OF02I7G3R.42.38.D05.1.454.CMB.1.raw
  modified_base (240)..(240): a, c, t, g, unknown or other
  misc_feature (240)..(240): n is a, c, g, or t
  modified_base (245)..(279): a, c, t, g, unknown or other
  misc_feature (245)..(279): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttcccctggcgccctgctccaggagcacctctgggggcacagcggccctcgggcgtgcctggtcaaggactacttccacagtacgtcactgagcggctggcaggcgnatagnnnnnnnnnnnnnnnnnnnnnnnnnnnnnnnnnnn

SEQ ID NO: 71381 - DNA, 248 bp, Homo sapiens; identical to SEQ ID NO: 71376
  misc_feature: GYAE6OF02G449X.42.38.D05.1.454.CMB.1.raw
  modified_base (245)..(248): a, c, t, g, unknown or other
  misc_feature (245)..(248): n is a, c, g, or t

SEQ ID NO: 71382 - DNA, 248 bp, Homo sapiens; identical to SEQ ID NO: 71376
  misc_feature: GYAE6OF02GN2MK.42.38.D05.1.454.CMB.1.raw
  modified_base (245)..(248): a, c, t, g, unknown or other
  misc_feature (245)..(248): n is a, c, g, or t

SEQ ID NO: 71383 - DNA, 246 bp, Homo sapiens; identical to SEQ ID NO: 71319
  misc_feature: GYAE6OF02INW4U.42.38.D05.1.454.CMB.1.raw
  modified_base (244)..(246): a, c, t, g, unknown or other
  misc_feature (244)..(246): n is a, c, g, or t

SEQ ID NO: 71384 - DNA, 547 bp, Homo sapiens
  misc_feature: GYAE6OF02JHSI4.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgcctcagtgtctggggccccagggcagagggtcaccatctcctgcactgggaacatttcaacatcgggcacgttatgatgttcactggtatcagcaacttccaggaacacgccccaagcctcctcatctatgtaataatatcgcctgacggggtcctgaccgtattctactgtctccaggtctggcacctcacgtccctccgtcggccatccacgtcggctccgagttgagtagtgacgctcgtactatctagttcgtctacgttccatcgacgtagtcgtaccgtacgtcggtaacgggttttcgggaccggggggtaccgaacggtccgtacggtaccggtccgtcggtccgtcgacgtacccgg

SEQ ID NO: 71385 - DNA, 160 bp, Homo sapiens; identical to SEQ ID NO: 71373
  misc_feature: GYAE6OF02HILYO.42.38.D05.1.454.CMB.1.raw
  modified_base (159)..(160): a, c, t, g, unknown or other
  misc_feature (159)..(160): n is a, c, g, or t

SEQ ID NO: 71386 - DNA, 248 bp, Homo sapiens
  misc_feature: GYAE6OF02JLHB1.42.38.D05.1.454.CMB.1.raw
  modified_base (243)..(248): a, c, t, g, unknown or other
  misc_feature (243)..(248): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaaggcccatcggtcttccccctggcgccctgctccaggagcacctctgggggcacagcggccctgggctgcctggtcaaggactacttccacatacgtcactgagcggctggcaaggcgcatagnnnnnn

SEQ ID NO: 71387 - DNA, 247 bp, Homo sapiens
  misc_feature: GYAE6OF02GNNPD.42.38.D05.1.454.CMB.1.raw
  modified_base (245)..(247): a, c, t, g, unknown or other
  misc_feature (245)..(247): n is a, c, g, or t
tcagtgacgtatgtcacgaccggtgctcgatttagtatctgatagttgggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnn

SEQ ID NO: 71388 - DNA, 249 bp, Homo sapiens; identical to SEQ ID NO: 71336
  misc_feature: GYAE6OF02G9KET.42.38.D05.1.454.CMB.1.raw
  modified_base (245)..(249): a, c, t, g, unknown or other
  misc_feature (245)..(249): n is a, c, g, or t

SEQ ID NO: 71389 - DNA, 247 bp, Homo sapiens; identical to SEQ ID NO: 71349
  misc_feature: GYAE6OF02HSEI4.42.38.D05.1.454.CMB.1.raw
  modified_base (245)..(247): a, c, t, g, unknown or other
  misc_feature (245)..(247): n is a, c, g, or t

SEQ ID NO: 71390 - DNA, 281 bp, Homo sapiens
  misc_feature: GYAE6OF02I4JDV.42.38.D05.1.454.CMB.1.raw
  modified_base (254)..(259): a, c, t, g, unknown or other
  misc_feature (254)..(259): n is a, c, g, or t
  modified_base (261)..(261): a, c, t, g, unknown or other
  misc_feature (261)..(261): n is a, c, g, or t
  modified_base (263)..(281): a, c, t, g, unknown or other
  misc_feature (263)..(281): n is a, c, g, or t
tcagtgacgtatgtcacgaccggtgctcgatttagtatctgatagttgggtttgggtagagtgggaagtcggtgggactcctggggacagggaaaccgtggtcaccgtctcctcagcttccaccaaggccatccggtcttccccctgcgccctgctccaggagcacctctgggggcacagcggccctgggctgcctggtcaaggactacttccgacactacggtcaactgagcgggctggacaaggcgcatagnnnnnnancnnnnnnnnnnnnnnnnnnn

SEQ ID NO: 71391 - DNA, 550 bp, Homo sapiens
  misc_feature: GYAE6OF02JBKU9.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgcctcagtgtctggggccccagggcagagggtcaccatctcctgcactgggaacaatttcaacatcgggggcacgttatgatgttcactggtatcagcaacttccaggaacagcccccaagctcctcatctatggtaataataatcggccctgacggggtccctgaccgattctctcgtctcctaggtctggccacctcacgccctccctcggcccatcacgtcgggcctccgagttgagactgagctgactatcatttcgctacgtccatcgacagtcgcctacgtcggtacgggttttccgggaccggggggtaaccaaggtccgtacggtacccggttcccgtcgtcggtaccgtacggtaccccgg

SEQ ID NO: 71392 - DNA, 247 bp, Homo sapiens; identical to SEQ ID NO: 71349
  misc_feature: GYAE6OF02GZOCB.42.38.D05.1.454.CMB.1.raw
  modified_base (245)..(247): a, c, t, g, unknown or other
  misc_feature (245)..(247): n is a, c, g, or t

SEQ ID NO: 71393 - DNA, 524 bp, Homo sapiens
  misc_feature: GYAE6OF02G8FJK.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacatttcaacatcggggcacgttatgatgttcactggtatcagcaacttccaggaacagccccaagctcctcatctatggtaataataatcggcctcagggtcctgacctattctctgtctccaggtctggcacctcacgcctccctcggccatccacgtcgggcctccgagttcgaggtagtgaggtctagactagtctagttcgtctacgtccctatcgacgagtcgctacgtggtcgggtttcggcgggggacctaggcgtcgaccgtccgtcgcgtcgacgtacccg

SEQ ID NO: 71394 - DNA, 248 bp, Homo sapiens; identical to SEQ ID NO: 71376
  misc_feature: GYAE6OF02IQ26M.42.38.D05.1.454.CMB.1.raw
  modified_base (245)..(248): a, c, t, g, unknown or other
  misc_feature (245)..(248): n is a, c, g, or t

SEQ ID NO: 71395 - DNA, 271 bp, Homo sapiens
  misc_feature: GYAE6OF02H1YE9.42.38.D05.1.454.CMB.1.raw
  modified_base (248)..(271): a, c, t, g, unknown or other
  misc_feature (248)..(271): n is a, c, g, or t
tcagtgacgtatgtcacgaccggtgctcgatttagtatctgatagttggtttgggagagtgggaagtcgtggactcctgggggacagggaaacctggtcaccgtctccctcagcttccaccaagggcccatcggtcttccccctggcgcctgctccaggagcacctctgggggcacagcggccctgggctgcctggtcaaggactacttccgacatacgtcactgagcgggctggcaaggcgcatagnnnnnnnnnnnnnnnnnnnnnnnn

SEQ ID NO: 71396 - DNA, 249 bp, Homo sapiens; identical to SEQ ID NO: 71331
  misc_feature: GYAE6OF02GLJ1O.42.38.D05.1.454.CMB.1.raw
  modified_base (244)..(249): a, c, t, g, unknown or other
  misc_feature (244)..(249): n is a, c, g, or t

SEQ ID NO: 71397 - DNA, 559 bp, Homo sapiens
  misc_feature: GYAE6OF02GY62U.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggggcacgttatgatgttcactggtatcagcaacttccaaggaaccacgccccaagcctcctcatctatcggtaaataataatcggccctcgacggggtccctgaccgtattctctgtctccaggtcctggctacctcacgtccctccctcggaccctactcacgtcgggtacctccggtaggttggacggtagtggagtctagactatctattcgtacacgtccagtgactgtcgccttagtcggtacgggtttcgggacgggggtacctaaggccgtacggtacccgtccgtcggcgtcgacgtacccgg

SEQ ID NO: 71398 - DNA, 541 bp, Homo sapiens
  misc_feature: GYAE6OF02GFTMS.42.38.D05.1.454.CMB.1.raw
  modified_base (382)..(382): a, c, t, g, unknown or other
  misc_feature (382)..(382): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggggcacgttatgatgttcactggtatcagcaacttccagaacagccccaagctcctcatctatggtaataataatcggccctcacggggtccctgaccgattctctgtctccaggtctgcacctcacgcctccngccatcactcgggctccgagttgagatgagctgactatctattgtcacgtccatcgacgtacgtgcctagtacgggtacggggttttcgggccggggggtaaccaacgggtcgttacggacccggttccgtacggtccggttaccgacggtacccccgg

SEQ ID NO: 71399 - DNA, 554 bp, Homo sapiens
  misc_feature: GYAE6OF02H7CZQ.42.38.D05.1.454.CMB.1.raw
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgcctcagtgtctcggggccccagggcagagggtcaccatctctgcactgggaacatttcaacatcgggcacgttatgatgttcactggtatcagactaacttaccaaggaaccacgacccccaagtcctcctactactctagtaggtaataataacgtcggccctcgacgggtccctagaccgtattctcttgtcctccgtaggtctgccacctcacgtccctccgtgccatcacgtcggctcgagttgagtntgngcngactatctattcgcacgtcccatcgactagtcgaccttacgtgggtacgggtttccggggacggggtaacctaaggtccgtacgtcccggtccgttcggcgtccgacgtacccgg

SEQ ID NO: 71400 - DNA, 248 bp, Homo sapiens
  misc_feature: GYAE6OF02IR7K7.42.38.D05.1.454.CMB.1.raw
  modified_base (244)..(248): a, c, t, g, unknown or other
  misc_feature (244)..(248): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnn

SEQ ID NO: 71401 - DNA, 583 bp, Homo sapiens
  misc_feature: GYAE6OF02H0R2X.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtcgtcggggccccagggcaggagggtcaccgatctcctgcacgtgggaacaatttcaacagtccggggcacgttatgatgttcactggtatcagcaacttccaggaacacgacccccaagcctcctacactctatacggtaaataataaacttccggaccctcgacgggggtccctggaccgtatttctcgttgtctccaggttctcggccaccttcacgtccctcccgtgcccatcacgtcggctcgagttgagatgagctcgtactagtctagttcgactacgtaccagttacgacgtagtcgtacctacggttggtacggggtttccgggacgggggtacccaaggtccgtacggtacccgtccgttcggccgttaccgacggtaccccg

SEQ ID NO: 71402 - DNA, 509 bp, Homo sapiens
  misc_feature: GYAE6OF02GCCUJ.42.38.D05.1.454.CMB.1.raw
  modified_base (501)..(501): a, c, t, g, unknown or other
  misc_feature (501)..(501): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggggcacgttatgatgttcactggtatcagcaacttcaggaacagccccaagctcctcatctatggtaataataatcggccctcgacggggtccctgaccgattctctgtctccaggtctggcacctcagtccctcctggccatcactcgggctccgagttgaggatgagctgactatcattgtcagtcccatgacagtgacctagtggtagggtttcggcgggggtaccaggtcgtcgaccgtccgtgcgtcncgtacccg

SEQ ID NO: 71403 - DNA, 591 bp, Homo sapiens
  misc_feature: GYAE6OF02H2QPY.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaattcaacatcggggcacgttatgatgttcactggtatcagacaacttcaggaacacgccccaacgctcctcatctatagtaataataatcgtcctcacgggtcctcgaccgtacttctctcgtctcctaggtcgtcgcacctcacgccctccctcggccctactcgactcgggtcctccgtaggttcgaggtagtggacggctcgactaacttctagtttcgtacacgttacccagtacgtacgaggttcgtcccgttacgttcgggttacgggggtttttccggggcgggggggtaacccgtaacggccgtacggtacccggttcccgtggtcccgtaccgacggtaaccccgg

SEQ ID NO: 71404 - DNA, 556 bp, Homo sapiens
  misc_feature: GYAE6OF02I846J.42.38.D05.1.454.CMB.1.raw
  modified_base (334)..(334): a, c, t, g, unknown or other
  misc_feature (334)..(334): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgcctcagtgtctggggccccagggcagagggtcaccatctcctgcactggaacaattcaacatcgggcacgttatgatgttcactggtatcagcaacttccagacacgccccaagctcctcatctatggtaataataatcgcctgacgggtccncgaccgattctctcgtctcaggtctcggcacctcacgtccctcccgtcggccctactccacgtcgggcctccggtagttcgaggtctcggagtctgtactatctagttcgtctacgtcccaagtcgacgtagtcgccttagtcgggttacggggttttccgggacgggggtaccaacggtcgtacggtacccgttccgtcggtccggtacgacggtacccgg

SEQ ID NO: 71405 - DNA, 260 bp, Homo sapiens
  misc_feature: GYAE6OF02HLU0T.42.38.D05.1.454.CMB.1.raw
  modified_base (247)..(260): a, c, t, g, unknown or other
  misc_feature (247)..(260): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggccgccctgctccaggagcacctcgtgggggcacgagcggccctgggctgcctggtcaaggactacttccacatacgtcactgagcgggctggcaaggcgcatagnnnnnnnnnnnnnn

SEQ ID NO: 71406 - DNA, 639 bp, Homo sapiens
  misc_feature: GYAE6OF02HSCLN.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgcctcagtgtctgggccccagggcagaggtcaccatcctctgcacgtgggaactaatttacaacatcggggcaacgttatgtatgttcactggtatcagcaacttccaggaacacgccccaagcctcctacatctaatagtaaataataactcggaccctgaacggggtccctagaccgtattctcgtcgtctccgaggttcctacggtaccacctacacgtcccttccccgtcgcctactccgacgtcgggtccgtacgtaggttacggaggtacgtaggacggtctacgtaacttacgtacgttacgttcgtacgtacgttacccgagtacgaaccgtacggtacggtaccgttacggttacgggttacggggttttccggggaccggggggtaacctaacggtaccgtacggtaacccggtccgttacgggtccgttaccggaccgtaaccccggg

SEQ ID NO: 71407 - DNA, 251 bp, Homo sapiens
  misc_feature: GYAE6OF02GMUEP.42.38.D05.1.454.CMB.1.raw
  modified_base (245)..(251): a, c, t, g, unknown or other
  misc_feature (245)..(251): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnn

SEQ ID NO: 71408 - DNA, 249 bp, Homo sapiens; identical to SEQ ID NO: 71336
  misc_feature: GYAE6OF02HP4O1.42.38.D05.1.454.CMB.1.raw
  modified_base (245)..(249): a, c, t, g, unknown or other
  misc_feature (245)..(249): n is a, c, g, or t

SEQ ID NO: 71409 - DNA, 249 bp, Homo sapiens; identical to SEQ ID NO: 71336
  misc_feature: GYAE6OF02JBN2O.42.38.D05.1.454.CMB.1.raw
  modified_base (245)..(249): a, c, t, g, unknown or other
  misc_feature (245)..(249): n is a, c, g, or t

SEQ ID NO: 71410 - DNA, 246 bp, Homo sapiens
  misc_feature: GYAE6OF02ITSGU.42.38.D05.1.454.CMB.1.raw
  modified_base (243)..(246): a, c, t, g, unknown or other
  misc_feature (243)..(246): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcggctggcaaggcgcatagnnnn

SEQ ID NO: 71411 - DNA, 248 bp, Homo sapiens; identical to SEQ ID NO: 71376
  misc_feature: GYAE6OF02G36BZ.42.38.D05.1.454.CMB.1.raw
  modified_base (245)..(248): a, c, t, g, unknown or other
  misc_feature (245)..(248): n is a, c, g, or t

SEQ ID NO: 71412 - DNA, 252 bp, Homo sapiens
  misc_feature: GYAE6OF02GCCN4.42.38.D05.1.454.CMB.1.raw
  modified_base (246)..(252): a, c, t, g, unknown or other
  misc_feature (246)..(252): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctgggcaaggcgcatagnnnnnnn

SEQ ID NO: 71413 - DNA, 632 bp, Homo sapiens
  misc_feature: GYAE6OF02FSRM6.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctggggccccagggcaggagggtcaccatctcctgcactgggaacaatttcaacagtcggggcacgttatgatgttcactggtatcagctaacttcagaacacgccccaagctcctcatctatggtaataataatccggaccctcgacggggtccctagaccgtattcctctcgtctccgaggtctcggcctaccgtcacgcccttccccgtcggtaccctactccgtacggtcgggtcctacccggtaggttacggagggtagttcggaacggtcgtacgtaactattactagttcgtactacgtaccctagtacgtacgaggtacggtaccttacgtagggttacggggttttaccggggaccgggggggtaaccgtaaccgggtccgtaccggtacccggttacccgttacggtccggtaccgtaccggtaaccccgg

SEQ ID NO: 71414 - DNA, 760 bp, Homo sapiens
  misc_feature: GYAE6OF02IC6HS.42.38.D05.1.454.CMB.1.raw
  modified_base (262)..(262): a, c, t, g, unknown or other
  misc_feature (262)..(262): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctctcactctcctcgctcactgcacaggtcctgggcccagtctgtactgacgcagccgccctcagtgtctcggggccccagggcagagggtcaccatctcctgcacgtgggaactaatttcaacagtcggggctacgttangattgttcactggtactcgaacgtacaaccttccgaaggaaccaccgacccccaagtccctacctactactctaagttaggtaaattaactaacgtccggaccctcgacgggttcccngaccgtattcncgtcgtcctccgtacggttcgtacggtaccctaccgtcgacgtccccgtcccgtcggaccctagttaccgaccggttccggggtcccgttacccggtacgggtttacgggaacgggttacgttacggggtaacggtccgtaacgtaacccgtttaagttaccgttacgttttacggtacccgttaaccgttacccttacgtaaccggaaccgttcggttaacccggttaccgttaaccggttttacgggggtttaaccggggggtttttaccgggggaaccgggggggtaaccccgtaacgggttccggttaaccggttaccccggttccggttaccgggtacccgttaccggaccggtaacccccggg

SEQ ID NO: 71415 - DNA, 250 bp, Homo sapiens
  misc_feature: GYAE6OF02GTGJI.42.38.D05.1.454.CMB.1.raw
  modified_base (242)..(250): a, c, t, g, unknown or other
  misc_feature (242)..(250): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaagactacttccacatacgtcactgagcggctggcaaggcgcatagnnnnnnnnn

SEQ ID NO: 71416 - DNA, 752 bp, Homo sapiens
  misc_feature: GYAE6OF02FVYR3.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcacgccgccctcagtgtcgtcggggccccgagggcaggagggtccaccatcctcctgcacgtgggaactaattacaacacgtcggggctacgttatgattcgttactacgtggttactacgacgtacctaaccttaccgaacggaaccacccgaccccctaacgacctacctactacttacgttacgttaacggttaaattaacttaacgtcccggtacccgttacgggaccggggttcccgtaccggtaaccgttactttaccgttcgttcgttccgtaccgtcggttccgtacgtacccgtaccgtccgtacccgtccccttacccgcggtaccctactaccggtaccggttccgggcccgttacgggttacggttacggtacggtagtacgggtacgtccgtagttaaccgttataccgtattacgtaccgtaccgttaccagttacgaacgttacggccggttaccttcgggttaccggggtttacgggggtttaccgggggaccgggggtaacctacgggtccggtaccggtaccggttaccggtcgtacccggtaccgaccggtaccccgg

SEQ ID NO: 71417 - DNA, 259 bp, Homo sapiens
  misc_feature: GYAE6OF02H4E8D.42.38.D05.1.454.CMB.1.raw
  modified_base (245)..(259): a, c, t, g, unknown or other
  misc_feature (245)..(259): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactacttccacatacgtcactgagcgggctggcaaggcgcatagnnnnnnnnnnnnnnn

SEQ ID NO: 71418 - DNA, 661 bp, Homo sapiens
  misc_feature: GYAE6OF02FLSJS.42.38.D05.1.454.CMB.1.raw
  modified_base (382)..(382): a, c, t, g, unknown or other
  misc_feature (382)..(382): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcacgccgccctcagtgtctcggggccccagggcagagggtcaccatctcctgcactgggaacaatttcaacagtcgggcacgttatgattgttcactggtactcagactaactccgaggaaccacgaccccaacgcctcctacatactatagtaataataacgtccgcctacgtacggggtcctacggaccgtacttctctcgtccnccgtaggtctcggctaccgtcacgtccctcccgtcggccctactccgtaccggtcgggtccctaccggtacggttcgacgggttacgtcggtacggtaccgtacgtaaccttgtaccgtagtttacgttaccgaaccgttacccgtagtccgtacgtaccggtcgtaccttacggtacggggtttaccgggggtttaccggggaccgggggggtaacctaacggtcccggttaccggtacccggttccgtcggtacccggtaccgacccggtacccggg

SEQ ID NO: 71419 - DNA, 249 bp, Homo sapiens; identical to SEQ ID NO: 71331
  misc_feature: GYAE6OF02GB5H1.42.38.D05.1.454.CMB.1.raw
  modified_base (244)..(249): a, c, t, g, unknown or other
  misc_feature (244)..(249): n is a, c, g, or t

SEQ ID NO: 71420 - DNA, 577 bp, Homo sapiens
  misc_feature: GYAE6OF02G5RNT.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctaactctcctcgctcactgcacagggtcctgggcccagtctgtactgacgcagccgccctcagtgtctggggcccccagggcagagggtcaccatctcctgcactgggaacaatttcaacatcggggcacgttatcgatgttcactggtatcagcaacttcaggacacgccccaagctcctcatctatggtaataataactcggccctcgacgggggtccctgaccgtactttctctcgtctccaggtcctcggccacctcacgtccctcccgtcggccatcacgtcgggctccggagttggaggtatgaggtctgtactatcagtttcgactacgtccctagtacgacgtacgtcgacccttacggtcggttacggggttttccggggaccggggggtaccaacggtccgtacgtcccggtcctcggtccggtctacggaccctaaccggg

SEQ ID NO: 71421 - DNA, 639 bp, Homo sapiens
  misc_feature: GYAE6OF02GC1U6.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagccgccctcagtgtctcggggcccccagggcaggagggtccaccatctcctgcactgggaactaattcaacatcggggcacgttatgattgtcacgtgtatcagcaacttccaggacacgccccaagcctcctcatctatggtaaataataacgtccgaccctcgacgggtccctgaccgtattccttactcgtctaccgtaggttctcggcctaccgtctacgcccgttaccctcggacctatctaccgtcgggtacctccggaggtttggacggtagtcggagtctacgtaactacgtacgtacgttcgttcctaacgtccccgtaatacgaaccgtagggttccggtaccttacggtggggttacggggttttacccgggggaccggggggtaaaccctaacggtccggttacccggtaccggttccgacgggtacccgttacggaccggtaaccccgg

SEQ ID NO: 71422 - DNA, 255 bp, Homo sapiens
  misc_feature: GYAE6OF02I0ZUX.42.38.D05.1.454.CMB.1.raw
  modified_base (243)..(255): a, c, t, g, unknown or other
  misc_feature (243)..(255): n is a, c, g, or t
tcagtgacgtatgtcacgaccggtgctcgatttagtatctgatagttggttgggagatgggaagtcgtggactcctggggacagggaaacctggtcaccgtctcctcagcttccaccaagggcccatcggtcttccccctggcgccctgctccaggagcacctctgggggcacagcggccctgggctgcctggtcaaggactactccacatacgtcactgagcgggctggcaaggcgcatagnnnnnnnnnnnnn

SEQ ID NO: 71423 - DNA, 820 bp, Homo sapiens
  misc_feature: GYAE6OF02GRUTI.42.38.D05.1.454.CMB.1.raw
  modified_base (232)..(232): a, c, t, g, unknown or other
  misc_feature (232)..(232): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctcgggcccagtctgtactgacgcacgccgccctcagtcgtcgtcggggcccagggcaggacgggtcaccactcctccngcacgtacgggaaactaatttaccaacgtagtccggggactacgttatgtattcgttacacgttgtactcacgtactaaccttaccgaacggtaaccaaccggacccccgaaacgtccctaccttacctaacttaccgttaaagttaacgggttaaaaacttaacgttaaccgtacccgggtacccggttaaccggaccgggggttaccctacggtaacccgtttacttccgttaccgttcgttaccgtccgtacgggttccgtccgggacccttaccgttaccgacccgttcccctacccgtcggtaccctaacgtaccgttaccggtaccgggttacccttaccgggtaaggtttacggaggtacggttacggaccggttacgttacgtaactttactacgtttacgttcgtaacgttacccgttaactaggttaccgaaacgttccggttacggtaccgtttaacgggtacggggggttttaaccgggggtttaccggggggaacccgggggtacgtaaccgggttaccgttaccgggttacccggttccggaccggttaccgggtacccgacccggtaacccgg

SEQ ID NO: 71424 - DNA, 264 bp, Homo sapiens
  misc_feature: GYAE6OF02IALWE.42.38.D05.1.454.CMB.1.raw
  modified_base (248)..(264): a, c, t, g, unknown or other
  misc_feature (248)..(264): n is a, c, g, or t
tcagtgacgtatgtcacgaccggtgctcgatttagtatctgatagttggttgggagatgggaagtcgtggactcctggggacagggaacctggtcaccgtctcctcagcttccaccaagggcccatcggtcttccccctggccgccctgctccaggagcacctcgtggggcacgagcggcctgggctgcctggtacaaggactactccatatacgtcactggagcgggctggacaacggtcgcatagnnnnnnnnnnnnnnnnn

SEQ ID NO: 71425 - DNA, 670 bp, Homo sapiens
  misc_feature: GYAE6OF02GJOT4.42.38.D05.1.454.CMB.1.raw
  modified_base (563)..(563): a, c, t, g, unknown or other
  misc_feature (563)..(563): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacagggtcctgggcccagtctgtactgacgcagcccgccctcagtgtcgtcggggccccagggcaggacgggtcaccatcctcctgcacgtgggaaactaatttaccaaactagtccgggggacaacgttatgattcgttacactggtatcagacaacgttccgaaggaacaccgaccccaagcctcctacatacctagtagtaaataataacgtccggacctcggacggggtccctacggaccgtcttcctcgtcgtcctccgtacggtcgtacggctaccctcgacctcccgtaccgtcgcccagttccgacggtccgggtccctaccgggtaggttcggaacggtcgtagggtacgtccgtaaggtacttacgtccgttaagttccgtacgtaccgttaccgaactaggtaaccncgggttaccgtaccgttacggttcggggttcgggtttaccggggggacgggtacccgtacgggtacttccgggaccgttccggacgtccggtaccaccggtaaccgg

SEQ ID NO: 71426 - DNA, 299 bp, Homo sapiens
  misc_feature: GYAE6OF02HB1DJ.42.38.D05.1.454.CMB.1.raw
  modified_base (108)..(108): a, c, t, g, unknown or other
  misc_feature (108)..(108): n is a, c, g, or t
  modified_base (255)..(259): a, c, t, g, unknown or other
  misc_feature (255)..(259): n is a, c, g, or t
  modified_base (261)..(299): a, c, t, g, unknown or other
  misc_feature (261)..(299): n is a, c, g, or t
tcagtgacgtatgtcacgaccggtgctcgatttagtatctgatagttgggttgggagatgggaagtcgtggactcctggggacagggaaacctggtcaccgtctcctnagcttccacaaggcccatcggtcttccccctggcgccctgctccaggagcacctcgtgggggcacgaggccggcccgtgggctgccgtggtcaaggactacttccacatacgtcactgacggcgggctggacgaaggcgacagtagnnnnnannnnnnnnnnnnnnnnnnnnnnnnnnnnnnnnnnnnnnn

SEQ ID NO: 71427 - DNA, 255 bp, Homo sapiens
  misc_feature: GYAE6OF02IDQJU.42.38.D05.1.454.CMB.1.raw
  modified_base (243)..(255): a, c, t, g, unknown or other
  misc_feature (243)..(255): n is a, c, g, or t
tcagtgacgtatgtcacgaccggtgctcgatttagtatctgatagttggtttgggagatgggaagtcgtggactcctggggacagggaaacctggtcaccgtctcctcagcttccaccaaggcccatcggtcttccccctggcgccctgctccaggagcacctctgggggcacagcggccctgggctgcctggtcaaggactacttccacatacgtcactgagcggctggcaaggcgcatagnnnnnnnnnnnnn

SEQ ID NO: 71428 - DNA, 787 bp, Homo sapiens
  misc_feature: GYAE6OF02GU6ZX.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgagggtcctcgggccagtctgtactgacgcacgccgcctcagtgtcgtcggggcccgagggcgaggacgggtcaccactcctcctgaccacgtacgggaaactaactttaccaactacggtacggggtaccgtaacggttaagtaggtaacgtttggttactacgttagggtacttacgacgtacctaaccttaccggaacggtaaaccgaccccggaccccgaaacggtacctccgtactaactaccgttaagttacggttaaaacgttaacgttaaacggtcccggtacccgttaccgggtaaccggggggttccctaccggtaccgttacgtttacgtccgttcgtacccgttcgtacggttcggtccgtccgtacccgtccgtaccctccccgtcccggtaccggtccctacgtccgtacggtccgggtacccgtaccggtaggttacggtaggtacgggtcgtacggtctacggtaaccttataccgttacgtttccgtacgtacgtaccctcggtaacggtacgtacgtacggttaccgttagggttaccggggtttacggggtccggggaccggggttaacgaccggtaccggtccggttccggtccgtcgtaccggtcgaccggtacccggg

SEQ ID NO: 71429 - DNA, 805 bp, Homo sapiens
  misc_feature: GYAE6OF02IOM1Z.42.38.D05.1.454.CMB.1.raw
  modified_base (123)..(123): a, c, t, g, unknown or other
  misc_feature (123)..(123): n is a, c, g, or t
tcagtgacgtatgtcacgaccggtgctcgatttagtatctgatagttgggtttgggggcttcagctgtgggcacaagaggcagcactcaggacaagctccagcatggcctggtctcctctccncctcactctcctcgctcactgcacgacgggtcctgggcccagtcgtcgtactcgaccgcacgcccgtcctctagtcgtcgtccggggccccgaagggcaacggacgggtaccactactcctcgtcaccgacgtacgggaaacttacgtttacaacgtacgtacggggcctacgttaatggtacttacgtaccgtacgtgtatactacggtacctaacctacgaacgtaaccgaccaccccgaattcccctacctctaacgttccgtaagtttaaagtaaacgtaaacttaaccggtcccggtaccgtaaccggtaccggggtaccccgttgtaaacccgtacggtttcttaccggtaccggtttcctaccgggttacggttaccggtacggtacccgtaaccgtccggttaacccgttcccggtccccgttacccgtacccgttacgttacccggtaaccggtttcccgggtaccggtaccgggtttacgacggggtaacgacgttaggacgtaccgttcgtatattccgttacgttagtaccctacgtacctacggtactacgtaaccgggttcgaccgttacgggtttaccgggtacgggggtttccggggaccgggttaacccggttgaccggttaccggtaccggttacgttcggacccgttacgaaccggtccccgg

SEQ ID NO: 71430 - DNA, 777 bp, Homo sapiens
  misc_feature: GYAE6OF02HJXOR.42.38.D05.1.454.CMB.1.raw
tcagtgacgtatgtcacgaccggtgctcgatttagtatctgatagttgggtttgggggcttcagctgtgggcacaagaggcagcactcaggacaagctccagcatggcctggtctcctctcctcctcactctcctcgctcactgcacgagggtcctgggcccagtctgtactgacgcacgccgccctcagtgtccgtcggggccccagggcaggtacgggtccaccgactctcctgacacgtaggaactatttacaactaggtaccgggtctacgttatgtaattcgttaccagtacggtatacgacgtacctaaccgttaccgaaggaaccgaccccgaccccgtaagtccttacctactacgttactaacgttaagtaaactaaagttaaccgtccggtacccgttaccggtaaccgggttccctaacggtaacccggttacttccgttacgttccgttaccgttacccggtcggttcctacgggtacccttaccgaccgtaaccggttccccgtacccggtagacccttacgtaaaccggttccggtaccgggtacccgttaccggttaagggaggttaccggtaacgtggtaacggttccaacggttaaccttacggttcttaacgttcgtaacctaccggttacctaaggtccgtaagggtccgttactacccggtttaggttccgggggtttacggggtacccgggggaacggtaactacccgggtagtcccgttaaccgtcggtacggtcctcccgggaactaccccggg

SEQ ID NO: 71431 - DNA, 635 bp, Homo sapiens
  misc_feature: GYAE6OF02JSLHS.42.38.D05.1.454.CMB.1.raw
  modified_base (230)..(230): a, c, t, g, unknown or other
  misc_feature (230)..(230): n is a, c, g, or t
  modified_base (496)..(496): a, c, t, g, unknown or other
  misc_feature (496)..(496): n is a, c, g, or t
  modified_base (516)..(516): a, c, t, g, unknown or other
  misc_feature (516)..(516): n is a, c, g, or t
tcagtgacgtatgtcacgaccggtgctcgatttagtatctgatagttggggtttggggcttcagctgtgggcacaagaggcagcactcaggacaagctccagcattggcctggtctcctctcctcgtcacgtctcctcgctcactgcacagggtcctggcccaagtctgtacgtgacgcagcccgcctcgagtgtcctcgggccccagggcaggacggtcaccatctccngcgtacgtggaactattacaacgagtacgggcacgttagtagtagttcgtacagtcggtatacagactacttaccgagtacacgacccctaagtcctcgtacacgtacgttagtacgttaaactaacgttaacgttcccggaccgttacggtaccggggtaccctacggggtaacccttacttcgtaccgttcggtaccttacgacggtactccgacctacgtcgtacgtcccttccgtacgtccacttccgacgtcggtacctgnggttcgaaggtctagacgtnacgtactacgtatacgttcacgtacgtcctagtacgcgtagctacgagttacggacgggttacggaccggttccgagaccggttacgtacccgtactacggtcccgtgacccgtaacgg

SEQ ID NO: 71432 - DNA, 782 bp, Homo sapiens
  misc_feature: GYAE6OF02JBN3G.42.38.D05.1.454.CMB.1.raw
  modified_base (650)..(650): a, c, t, g, unknown or other
  misc_feature (650)..(650): n is a, c, g, or t
tcagtgacgtatgtcacgaccggtgctcgatttagtatctgatagttgggtttgggggcttcagctgtggcacaagaggcagcactcaggacaagctccagcatcggcctggtctccgtctcctcctcacctcctcctcgctcactgcacagggtcctcgggcccagtctctacgtcgacgcgacgcccgtccctcacggtcgtccggtcgggcccgagggcaggacggtcacctactctccgtgaccacgtggtaactaactttacgaacgtcggtacgggacttacgttacgtgtacgttacgttacctacgttagtactacgaaccgtaactacccgttaacgaaccggtaaccgaacccgcccccgtaaacgtcccttaccgtacttacgtactaacggttacggttaaattaacctaacggtccgaccgtaacggaccgggttccgtacgtaccgtttcttccgtcgttacgttacctccggtaacggtccgtacggtacctacccgtcgtacccgtccgtacccgtcggtaaccctcgtaacgtaccggtcggtaccgtaccggtagttacggaccggtacggtacggtacgttcgtaaccggttacttagtcgttaaccgtttcgtaacccgtaccgttaacngggttaccaaggttacccgttcggtaacgttaacgggccggggtttttaacgggacccggggtacgggtacccgttagggtacccgttccgggtacgtttccgaccgggttcgtaccggtcccgtaacccgg

SEQ ID NO: 71433 - DNA, 344 bp, Homo sapiens
  misc_feature: GYAE6OF02HNCFR.42.38.D05.1.454.CMB.1.raw
  modified_base (151)..(151): a, c, t, g, unknown or other
  misc_feature (151)..(151): n is a, c, g, or t
  modified_base (308)..(344): a, c, t, g, unknown or other
  misc_feature (308)..(344): n is a, c, g, or t
tcagtgacgtatgtcacgaccggtgctcgatttagtatctgatagttggggttgggagatgggaagtcgtggactcctggggacagggaaacctggtcaccgtctcctcagccttccaccgaagggcccatcggtccttcccccgtggccnccctgcctccgaggacgccacctcgtggggggcacgacggccggtcccgtggggcttgcccgttggtaccgaaagggaccttacctttacccgactaattacccggtccaacgttcggacggcggggccgtgggaccgaacgggtccgactagtagnnnnnnnnnnnnnnnnnnnnnnnnnnnnnnnnnnnnn

SEQ ID NO: 71434 - DNA, 786 bp, Homo sapiens
  misc_feature: GYAE6OF02FJKGS.42.38.D05.1.454.CMB.1.raw
  modified_base (213)..(213): a, c, t, g, unknown or other
  misc_feature (213)..(213): n is a, c, g, or t
  modified_base (747)..(747): a, c, t, g, unknown or other
  misc_feature (747)..(747): n is a, c, g, or t
tcagtgacgtatgtcacgaccggtgctcgatttagtatctgatagttgggtttgggggctttcagctgtgggcacaagaggcagcactcaggacaagctccagcatgctggtctcctctcctctcactctcctcgtctcactgcacgtacgggtcctacgggccctagtctcgtacgtgacgcgacgcccgccctcagtgtcgtgggccacgnggccgaggagggtccaccgtactcctaccgtgaccacggtacgggaacttacttacaacgtagtccggggtactaaccgtttgtgtacgttacgttccgtaagttcggtacttcgacgtacgttaaccgttaccgaacgtaacccgacccgtaccgaaccgttccgtacccttaacgtaccgttaacggttacgttaaacggtaaaacttaaaccgttaccgtacccggttacctccgggtaaccgggttccccggttaacgtacccggttactttaccgtcggttccgttaccgttaccggtacggtttaccgcggaccgttaacccgtaccgtacccggtttcccacccggtttccgggtaaccctacgtacccgtttcgggaccggttaccgttaccgggtagggtacccgtagggtacgttggaacggttcctacgtttacgagtttccgttacgtcgttacgttaaccgtcacggtaccgtgtccggtcgtaaccgtggtttcggtaccggggttcggaaccgggtacncggtacgtaccgtccggaccttcggacgtccgtacccgg

SEQ ID NO: 71435 - DNA, 790 bp, Homo sapiens
  misc_feature: GYAE6OF02FO4MF.42.38.D05.1.454.CMB.1.raw
tcagtgacgtatgtcacgaccggtgctcgatttagtatctgatagttggggtttgggggcttcagctgtgggcacaaggaggcagcactcaggacaagctccagcatggcctggtctcctctcctcctcactcctcctcgctctactgaccactacgggtccgtcggggcccacgttcttggtactgaccgacgacgcccgtccctctaggtggttccgccgggggtcccgagggcgaggtacgggtccactactcctctcgacacgtacggtaactacgttacacgtacgtcggggtactacgttagtagtacgttgttccgtacgtaggtactaccggtactaccgtaccctttaaccggaacggaaccctaacccggaaccccgaaccgtccgttacctactaacttaaccttaggttaacgtaaattaacgtaaccgtcccggtaccgttacgggtaccggtttcccgtaccggtaacgtttacttcgttaccgtaccgttacccgtacggttacggtccgttcggtcctacctaccgttaccgtccctccggcgttaccactcggtaccgtcggtccgtagttacggcgtaggtagtcggtacgtctacgttaatcgttacgttaccggtacgtttaccgaccgttacgtcgtacccgtaaggttccggttaccggtttcgttaacggttcggggggttaaacgggggtccggggtaacgggtacccggacgtttaccggcccgaccgggtttccacccggtcggtacccgtaggtacccccggg

SEQ ID NO: 71436 - DNA, 759 bp, Homo sapiens
  misc_feature: GYAE6OF01ARTSA.16.66.F11.1.454.CMB.1.raw
  modified_base (201)..(201): a, c, t, g, unknown or other
  misc_feature (201)..(201): n is a, c, g, or t
tcagtgtactactccacgaccggtgctcgatttagtcacgcgagaagggtgagaagtagtggagcctggagcatcccactatggcctgggctccactacttctcaccctcctcgctcactgcactaggttcttcgggcctaattttctactcgactcacgcccactctgtcgtcggagtcgtacggggaagacggtaaccntctctgccacccgcagcagtggcctaccgtttgccggtcttattatggtgctaggttcggttccaggcacggcccggcccgggcacggtccgcccccacgaggacgtgatctagtggaacggactaaccgtacggtccctcggtccggggttcccttccgtttccggttttcgtcgtcctccagtccggtaccgggtccctaccgtaccttcctccgtcccctccctaccacctacttccttcgtacggtaactacggaaacgtacggtacgggaacggggtacgacgggtcttacggaaccttacgtacgttcgtactaacgtttacttaagtacgtaaactaaaccgacgggtagggggttcgggttacgggttcgggacggggaacgggaaccgtacggccgttccgggtcccgttaccggtacggtaccgtaccggacccgtaacgggtcccgtcccgggtacccccgtttcggtaccctacccgtttcccgttcccgttccccccggcccttacccggtaccggttaacggttaacgtacccgtacggtcggg

SEQ ID NO: 71437 - DNA, 589 bp, Homo sapiens
  misc_feature: GYAE6OF01CZP36.16.66.F11.1.454.CMB.1.raw
  modified_base (184)..(184): a, c, t, g, unknown or other
  misc_feature (184)..(184): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
  modified_base (426)..(426): a, c, t, g, unknown or other
  misc_feature (426)..(426): n is a, c, g, or t
tcagtgtactactccacgaccggtgctcgatttagtcacgcgagaagggtgagaagtagtggagcctggagcatcccactatggcctgggctccactacttctcaccctcctcgctcactgcacaggttctggcctaattttctactgactcacgcccactctgtgtcggagtctccggggaanacggtaaccatctcctgccaccgnagcagtgctaccttgccgntatatgtgcagtgtccagcagcgccggncgccncccacagngtnatntangagactaccgtcgcctcgtcggtcctcgttcgttcncgtctcacgtcggaccgtcctcctactctcctccctccctcacctctctcgtacgacgtagaacgtacgtacggacggacgcgtctacgtactactctgtactacgttcttanactaactaacgcggtagggttggtcggtacgggacggaacggacgtacggtcgtacggtccgttacggtacgtaccgaccgaccgacggtccctcccggtccccgtcgtcctaccgttccctcccgtcccctaccctccgtacgtacgtaacgtcgtggtcgg

SEQ ID NO: 71438 - DNA, 626 bp, Homo sapiens
  misc_feature: GYAE6OF01DBR7L.16.66.F11.1.454.CMB.1.raw
  modified_base (103)..(103): a, c, t, g, unknown or other
  misc_feature (103)..(103): n is a, c, g, or t
  modified_base (184)..(184): a, c, t, g, unknown or other
  misc_feature (184)..(184): n is a, c, g, or t
  modified_base (206)..(206): a, c, t, g, unknown or other
  misc_feature (206)..(206): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
  modified_base (264)..(266): a, c, t, g, unknown or other
  misc_feature (264)..(266): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
tcagtgtactactccacgaccggtgctcgatttagtcacgcgagaagggtgagaagtagtggagcctggagcatcccactatggcctgggctccactacttcncaccctcctcgctcactgcacaggttcttgggcctaattttcactgactcagccccatctgtgtcggatcgtccggggaanacggtaccatctctgccaccgnagcagtggcacgttgccgtntattngtncngtggtccagcancgccgncncnccncannnatnangagatacgcgcctgtcggtcctcgttcgttcncgctctctcggcggtcctctactctccgcctcctcacncttctcgtacgtactagacgtacgaggacggacggtacgctacgtacttactactcgtactagttacttagtaacgtaactaaccgacggttacggggttacggtcgggttaccgggtacggggtaacgggaacccgtacggtaccggtccggtcccgttacgtacgggtaccgaccggtacccgtacgggcccgtcccggtccccggtaccgtcctaccgttcccgttcccggttccccgttcccgttaccgtaccggttacgttacggtaccgtacggtcggg

SEQ ID NO: 71439 - DNA, 580 bp, Homo sapiens
  misc_feature: GYAE6OF01CQR3B.16.66.F11.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
  modified_base (388)..(388): a, c, t, g, unknown or other
  misc_feature (388)..(388): n is a, c, g, or t
tcagtgtactactccacgaccggtgctcgatttagtcacgcgagaagggtgagaagtagtggagcctggagcatccccactatggcctgggctccactacttctcaccctcctcgctcactgcacaggttcttgggccaattttctactgactcacgccccactctgtgtcggagtcgtaccgggggaagacggtaaaccatcctcctgccacccgnagcagtggcaccttgccgntattangtgctagtggtccagcagcgcccgggcagtcnccanaccagagtgatcatgagactaacctacggccctgcgggtccctctcggtttcnggctccatcggacggtcctcactactcgccctcctacaccatcctgcggatggaaanacttggacggacgaggcctagaactactaacgtgtcagttacttaagtgaactaacacgagggttcggtgttcgggcgggaagggaccaaggtctacgggccgtaccgtaggtccgaacgcccgtaaaggctaccggcccccttcggtcaccttccgtccgttccccgccctacctgaacgtgtacctacgg

SEQ ID NO: 71440 - DNA, 584 bp, Homo sapiens
  misc_feature: GYAE6OF01A9YH4.16.66.F11.1.454.CMB.1.raw
  modified_base (399)..(399): a, c, t, g, unknown or other
  misc_feature (399)..(399): n is a, c, g, or t
tcagtgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtcgcccccacagagtgatctatgaggataacctacggccctcgtcggggtccctccgtcggttttctggctccgatcgacgggtcctccactactcgcctccctcaccatctctggactgaagctgaggacgnggctgacctactactgtcagttcttatgtaataaccaccgagggttggtcgttcgggacgggtagggaaccgaagccgtcgggcccgtcgtaggtccacgcccgaaggccctccggcccccgtcggtcccacgttcccgttccgttcccccgccccttcctaccggagttacgtaccgcgtcggg

SEQ ID NO: 71441 - DNA, 664 bp, Homo sapiens
  misc_feature: GYAE6OF01CZMNI.16.66.F11.1.454.CMB.1.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (358)..(358): a, c, t, g, unknown or other
  misc_feature (358)..(358): n is a, c, g, or t
tcagtgtactactccacgaccggtgctcgatttagtcacgcgagaagggtgagaagtagtggagcctggagcatcccactatggcctgggctccactacttctcaccctcctcgctcactgcacaggttcttgggccaattttctactgactcagccccactctgtgtcggagtcgtccggggagacggtaaccatctcctgcaccgcagcagtgcactttgccggntatangncagtgtccagcancgccggnagtccgccccacagagtgatctatgaaggtactaacctaccggccctcgtcggggtccctccgttcggttttctcggcctcactcgaccgggtcctccactacncgccctccctacacctactctacctggactgaaacgtaccgtaggacgggaacgacggcctacgtaacttacgtaacttggtactacgttactttagtacgtaaccttaaccgaaccggtaacggggttgggttacgggttccgggaacggggtaaccgtaacggaacggtccgtacgggtcccgttacgttaacggcgacgaccccgaaggtccctccggtaccccccgttacggtccctacgttcccgttcccgtttcccccgccccgttccgtacggtacggttaacgtaccgtgtacccggg

SEQ ID NO: 71442 - DNA, 776 bp, Homo sapiens
  misc_feature: GYAE6OF01A97YY.16.66.F11.1.454.CMB.1.raw
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (550)..(550): a, c, t, g, unknown or other
  misc_feature (550)..(550): n is a, c, g, or t
  modified_base (582)..(582): a, c, t, g, unknown or other
  misc_feature (582)..(582): n is a, c, g, or t
tcagtgtactactccacgaccggtgctcgatttagtcacgcgagaagggtgagaagtagtggagcctggagcatccccactatggcctgggctccactacttctcaccctctcgctcactgcacaggtttctgggcctaattttctactgactcacgccccatctggtgtcggagtccgtaccggggaataccggtaacntcctccngccaccgnagcagtcgctaccgtttcgccgtacttattgtggtgccgtaggttccggtaccagccgtacggccggcccggcgtacggtccccgacccccacgacggtagtcgtacttacgtagtaggaacggtaaccgtaaccgtcccggtcccgttaccgggttcccggggtttcccctttacccggttttccgggtttttccgtacggtccctttaccggtaccgttaccgggtacccggttcccctaccctaccgttacctcccgccccttcccctacctaccgtacttccgtacgtaccgggtactaagaacggtacgtaggaccgggaaggtccggtnttaaccgtacttaccgttacttcttaacggtntttaccgttagtaaccgttaaccgaaccggttacggggtaggttgggttaccgggtacggacggggaacgaccgtacggcgttccgccgtaccgtagcccgtaccgacgtaccgtcctcccgtacccggttcctacgtcccttcccgtttccctcccccgtccgtcctcggtaaccgttctaccgtggtccggg

SEQ ID NO: 71443 - DNA, 763 bp, Homo sapiens
  misc_feature: GYAE6OF01AZUS2.16.66.F11.1.454.CMB.1.raw
tcagtgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgccacccgcagcagtggcacctttgccggtctattagtgtgcagtggtccagcagcgcccgggcacgtcgccccacagagtgatctatggagactaaccgtacggccctcgtcggggtccctccgttcggtttctcggtcctccacgtccggtaccgggtccctaccgtaccttaccgtcgtccccttccctacctaccctacgttcctccgtacggtaccttacggaaacggtaccgtacgggtaacgggaccggtaacggtaccgttacggtaacccgttaaccttaacgttcgttaccgtaacgtttaccgtttaagtacgtaaacgttaaaccgtaaccgggttaacggggtttcgggtttacgggttaccgggggaccggggtaacggggtaacccgtaacgggtccggtaccggggtacccgttaccggtacgggtaccgtaccggaccccgaagggtccccgtacccggtccccccgttcgggtcccctacgttccgttaccccgttaccccctacccgttccgtacgttacgtaaccgtacgtccggtacggg

SEQ ID NO: 71444 - DNA, 883 bp, Homo sapiens
  misc_feature: GYAE6OF01A6R26.16.66.F11.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
tcagtgtactactccacgaccggtgctcgatttagtcacgcgagaagggtgagaagtagtggagcctggagcatccccactatggcctgggctccgactacttctcaccctcctcgctcactgcacaggttcttgggcctaattttctacgtgactccacgcccctactcgtgtagtccggagtccgtccggggaagtacggtaaccagtctccgtcgccacccgnagcgagtcgctaccgttggccggnttacttatgtcgactaggttcggttaccaggtccgaggtccggcccgggacgtacggtcccgaccccctacgagtacgtagagttctagttggaaggtacctaaaccgtcccggcccttggtccgggttccctccgtttccggtttttccgcgggtccttacccgtagtacccgggttccgggtaccctttacccgaacgtttacccgtcccggtccccctacccccgttacctcccccgtaatttccccgttacggtaccggaacctttcggaaacgttccgaaggtaccgggaacgccgtcgtaaccgtaaccgttaactttacgacgttacccgttaaggttacctttaagacgttaaacctaaacccgtaccggggtacggggttcgggttaccggggttacccggggaacggggtaccggtaaacccggtacggttccgggtacccgggttaccccgttacggggtttaacccggtaccggacccgtaacccgtaacccgggtccggttaacccccggccccgggtttacccgttaacccgtcccgttaacccgggttccccctttaccccccgaaccccggttccgttacccggtaaaggttacccgtaaccctaccggggtaccgg

SEQ ID NO: 71445 - DNA, 731 bp, Homo sapiens
  misc_feature: GYAE6OF01BHYWS.16.66.F11.1.454.CMB.1.raw
  modified_base (237)..(237): a, c, t, g, unknown or other
  misc_feature (237)..(237): n is a, c, g, or t
  modified_base (380)..(380): a, c, t, g, unknown or other
  misc_feature (380)..(380): n is a, c, g, or t
tcagtgtactactccacgaccggtgctcgatttagtcacgcgagaagggtgagaagtagtggagcctggagcatccccactatggcctgggctccactacttctcaccctcctcgctcactgcacaggttctgggcctaattttctactgactcagccccactctgtgtcggagtcgtccggggaagacggtaaccatctcctgccacccgcagccagtggctacctttgcccggtntattactgtggctagtcggttccagcgacgcggcccgggcagtccgacccccaaccagtacgtgacttacgtaagtggaacggaacttaaacccgtacccggtccctcggttacggggttccccttccgtttccggttttccncggcctaccagtccggtacccgggtcctacccgtactaccgccgtccccttccctacctacccgaacttctacgttcgggactacggaaagtacgtaggacgggaaccgacggcgtaacgtaaccttactaacgttcggtactaacgtttccgtattaagaaacttaaaccgaccggtaaggggtttcggttaacgggttccgggacggggtaacggtaacccgaagtcccggtacgggtacccgttaccgtaggtccaacgtacccgacggtcctcccggccccgttggacctaccgtccttacccgtccccctacccgtccttacggaaccggttactacgcgtacggg

SEQ ID NO: 71446 - DNA, 872 bp, Homo sapiens
  misc_feature: GYAE6OF01APVSC.16.66.F11.1.454.CMB.1.raw
tcagtgtactactccacgaccggtgctcgatttagtcacgcgagaagggtgagaagtagtggagcctggagcactcccactatggcctgggctccactacttctccaccctcctcgctcactcgccactacggtttcttcgggcctaactttttcctacttcgactcacgcccactctgtcgtcggacgtcggtaccgggggaacgaccggtaaccatcctcctcgccacccgcacgcaggtcggcctaccgtttcggccggtacttaagtttactggtcgacgtacggttcggttaccacggcgacggcccgggcccgggcacggtcccgacccccaccgaggacgtagactcgtagtaggaacggtaaacgttaaacccggtaccggtccccttcgggttccggggtttcccctttccggttttccggtttttccggtcgggtccttaccgtacgttaccgggtacccgggtttccctacccgtaaccttcccgttccgtccccttccccttaccaacccttacttccttaccgtacggtacgttaacggaaacgtacgtacggacgggaacggacggtactacgtaaccttaccgttacgttacgtacgttacgtttacttagttaacgtaaacgtaaacccggtacgggttacgggggttacgggttcggggttaccgggggaacggggaaaccgggtaaaccggtaacggtaccgggttccgggtacccggttaccggtaccgggtacgaacccggtacccggaccggtcccgtccccggtaccccgttccggtcccttacccgttcccgttccccgttccccgtccccttaccggttaccggttaaccgtacctacgaccggtcgg

SEQ ID NO: 71447 - DNA, 863 bp, Homo sapiens
  misc_feature: GYAE6OF01C8M9H.16.66.F11.1.454.CMB.1.raw
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
tcagtgtactactccacgaccggtgctcgatttagtcacgcgagaagggtgagaagtagtggagcctggagcatccccactatggcctgggctccactacttctcaccctctcgctcactgcacaggttcttggcctaattttctactgactcacgccccatctgtgtcggagtccgtccggggaagacggtaaccagtcctcctgccacccgnagccgagtggctacctttcggcccggtntattcgtgtntcgaggttcggttccagccgacggccggcccgggcacggtccgccccccacgtaagagtgacttcgtagtacggaaggtaaccttaaaccggtccggtcccctttcggtcccggggttccccctttcccgttttcgggtttttccgtcgggttccctccgtacgtaccgggtaccggtcccttaccctacccttacgttccctaccccttcccctacgacccttacttccgttactcgggtaacttacggaacttaccggtaggacgggtaccggtacggtaccctaaggttaacccttaacccgttacgtttccggtaacgttaccggtttacgtttaacgtaccggtaaaccttaccgggtaccgggtacgggggtttagggtttaccgggtccgggggttaaccggggaaccggtaccggtaacccgggtcgggttacccccgggtacccggtttacccgggttcggtacccggtaaccggtacccccggtaacggtccccgtacccccgttccccccgttacggtacccgttacccgtttcgttcccccggttcccccgtaaccccgttccgttaccggtacgttaaccggtccgacggttaccggg

SEQ ID NO: 71448 - DNA, 527 bp, Homo sapiens
  misc_feature: GYAE6OF02GLS31.16.66.F11.1.454.CMB.1.raw
  modified_base (330)..(330): a, c, t, g, unknown or other
  misc_feature (330)..(330): n is a, c, g, or t
  modified_base (523)..(523): a, c, t, g, unknown or other
  misc_feature (523)..(523): n is a, c, g, or t
tcagtgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttcnggctccatcgacgggtcctccactactgcctccctcaccatctctggactgaagctgaggacgaggctgactactactgtcagtctatgataacacgtagggtgtgtcggcggagggaccaagctggccgtctaggtcagccaggctcgcccctggcactctcgttccccacccctcctcgacgtacgtaccntcgg

SEQ ID NO: 71449 - DNA, 777 bp, Homo sapiens
  misc_feature: GYAE6OF02H6UYN.16.66.F11.1.454.CMB.1.raw
tcagtgtactactccacgaccggtgctcgatttagtcacgcgagaagggtgagaagtagtggagcctggagcatcccactatggcctgggctccactacttctcaccctcctcgctcactgcacacggttcttcgggcctaacttttctactcgactcacgcccactctgtcgtcggagtcgtccggggaagaccggtaaccatctcctgccacccgcacgcaggtcggcctaccgttttcggccggtacttatttatggtcgctaggttcggttccagcaggccggcccgggcacggtccgcccccaacgaggagtgactctagtagaggaactaaccgtaccggtccctcggtccggggttccccttccgtttccgggtttttcgtcgggtcctaccgtacgtccgggtaccgggttccctaccctaaccttaccgtccgtccccttacccctacctaaccctacttccttaccgttacgggtaaccttacggaaacgtacggtacgggaacggggaacgggacgggtaccttacggtaaccttaacgttacttcggtactacgtttactttaagacgtaaacttaaaccgacgggttaggggttcgggttcggtaccggggacggggaacgggaaccgaacggtccgtcgggtccgttacggtacgggtacaccggacccgaacggtccgtccccggtccccggtcggtaccctaccgttcctttcccgtccccctacccgttccgtacggtaacggttaccgtaccacgtcgg

SEQ ID NO: 71450 - DNA, 575 bp, Homo sapiens
  misc_feature: GYAE6OF02FF8R8.16.66.F11.1.454.CMB.1.raw
  modified_base (210)..(210): a, c, t, g, unknown or other
  misc_feature (210)..(210): n is a, c, g, or t
  modified_base (335)..(335): a, c, t, g, unknown or other
  misc_feature (335)..(335): n is a, c, g, or t
tcagtgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgcacccgnagcagtggcacctttgccggctattatgtgcagtggttccagcagcgcccggcagtcgcccccacagagtgatctatgaggataaccctacggccctcgtcggggtcccctccgttcggttttcnggctccatcgacggtcctccactactcgcctccctcaccatctctggactgaacgactgaggacgaggctgactactacttgtcagttctatgaactaacaccgtaggggtggttcggttcgggacggacgggaccaagcgtcgggcctccgtagtcacgacccaggtcctccgcccccgtggaccctacgtccttcggttcccccgcccttccctcggtacgtacgtaccgtacgtcgg

SEQ ID NO: 71451 - DNA, 666 bp, Homo sapiens
  misc_feature: GYAE6OF02IZ5J4.16.66.F11.1.454.CMB.1.raw
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
tcagtgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtctccggggaagacggtaaccatctcctgccacccgcagcagtggcacctttggccggtctattatggtgctagttcggttccagcaggccgcccgggcagtcgcccccaccagagtgatctatggaagataaccgtacggcctcgtcggggtccctcgttcggttttcncggctccatcggacggtcctccactacgtcgcccttcccnctacccatcctcgtggaccttaggaacgtctaggacggacgacggctagtactactactcgtacacgttcttatagtaactaaccacggtagggtacggttggttaccgggagggtacgggtaccaaggtccgtacgggtacccgttaccgtacgggtcgaaccggacccgtaacggtcccgtacccgtcccccggtacgggttaccctacccgtcccggttcccgttacccccggtccccgttaccgtaccggtaacgtaccgttaccgtccgtaccgggg

SEQ ID NO: 71452 - DNA, 820 bp, Homo sapiens
  misc_feature: GYAE6OF02I3TJB.16.66.F11.1.454.CMB.1.raw
  modified_base (312)..(312): a, c, t, g, unknown or other
  misc_feature (312)..(312): n is a, c, g, or t
  modified_base (386)..(386): a, c, t, g, unknown or other
  misc_feature (386)..(386): n is a, c, g, or t
  modified_base (811)..(811): a, c, t, g, unknown or other
  misc_feature (811)..(811): n is a, c, g, or t
tcagtgtactactccacgaccggtgctcgatttagtcacgcgagaagggtgagaagtagtggagcctggagcatcccactatggcctgggctccactacttctcaccctcctcgctcactgcacaggttcttgggccaattttctactgactcagccccactctgtgtcggagtcgtccggggaagacggtaaccatctcctgcacccgcagcaggtggctacctttggccggctattactgtcgctaggttggttccaggccacggccggccccggggctacggttccgacccccccgaaccaggacggtnacgtctaacgtgacgggtaactaacccgtacggtcccttcgttacggggtccccttccgtttccgggtttttcncgggtccttccgagttccggtaccggggttccctaccgtaccgttacgtccgtcccttcccctaccgaaccctacgttcctccgtaacgggtaccttaagggaaaccgtacgtacgggaacggggaaccgtacgggtaccttacggaacctttaacgttaccgttcgggtaccttacggttacctttaaggtacctaacgttaaaccccgaacgggttagggggtttcgtttacgggttccggggaaccggggttaaccggggaaccccgtaacgggtccggttaaccggggccccgtttaccggttaacggtccggtaaccggaccccgtaaaggggtccctaccgggtcccccggtaggttccctacgttcccgtccccggtttacccctacccgttccgtacggttaaccgtacgttaccgnggttacggg

SEQ ID NO: 71453 - DNA, 705 bp, Homo sapiens
  misc_feature: GYAE6OF02J0N8F.16.66.F11.1.454.CMB.1.raw
  modified_base (185)..(185): a, c, t, g, unknown or other
  misc_feature (185)..(185): n is a, c, g, or t
  modified_base (272)..(272): a, c, t, g, unknown or other
  misc_feature (272)..(272): n is a, c, g, or t
  modified_base (339)..(339): a, c, t, g, unknown or other
  misc_feature (339)..(339): n is a, c, g, or t
tcagtgtactactccacgaccggtgctcgatttagtcacgcgagaagggtgagaagtagtggagcctggagcatcccactatggcctgggctccactacttctcaccctcctcgctcactgcacaggttcttgggccaatttctactgactcagccccactctgtcgtcggagtctccggggaanacggtaaccatctcctgccaccgcagcagtcggctaccgtttgccggcttattatgtcgcagtcggttccagtccagccgcccgggnagtcaccccacagacgtgatctagtgaggactacctacggccctgtcgggtccctcgttcggtttcnggtctcagtcggacggtcctcgactactcgccctccgacaccatcctcgtcggtactggaacgtcgtagacgggtacgacggtctacgtaactacgtacttcgtacttacggtacctttagtacggtaaacttaaccggaccggtaagggggttacgggtcggttaaccggggaccgggtaacgggtacccaagggtccgtacgggtcccgtttaccgtaacggttccgaaccggtacccggaaagggtccccgtaacccgggttcccccggtcgggtaaccctccgtttacccggttaccccggttccccgtaccccgtttacccgtaccgggttaccgttaaccggtaccgtaacgtcccgggg

SEQ ID NO: 71454 - DNA, 645 bp, Homo sapiens
  misc_feature: GYAE6OF02I7WO8.16.66.F11.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (420)..(420): a, c, t, g, unknown or other
  misc_feature (420)..(420): n is a, c, g, or t
  modified_base (439)..(439): a, c, t, g, unknown or other
  misc_feature (439)..(439): n is a, c, g, or t
tcagtgtactactccacgaccggtgctcgattttagtcacgcgagaagggtgagaagtagtggagcctggagcatccccactatggcctgggctccactacttctcaccctcctcgctcactgcacaggttctgggccaattttcactgactcacgccccactctgtgtcggagtctccggggaagacggtaaccntctcctgccacccgnagcagtgctacttgccgntatntgtgcagtggtccagcagccgccggcagtcgcccccacagngtgactctatggaggactaacccgtcgccctcgtcgggtccccttcgttcggtttcnggtcctcgacgtcggaccggtccctccactccncgtcccctcccgtccaccctacttcgtactggaccttagaacgacgtggaggacgnggctaggacctactacgtntacgtagttacttagtacgaacttaaccgaccgtagggttcgggttcggtccgggacgggtacgggaaccgtacggtcgtccggtcccgtacgttacggccgtacgaccgtaggccgttaccgcccgtcccgttcgggtccttaacccgttccgttaccccgtttccccctcccgttacccgacggtacgtaccggtactaaccgg

SEQ ID NO: 71455 - DNA, 570 bp, Homo sapiens
  misc_feature: GYAE6OF02F1VRW.16.66.F11.1.454.CMB.1.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
  modified_base (351)..(351): a, c, t, g, unknown or other
  misc_feature (351)..(351): n is a, c, g, or t
  modified_base (361)..(361): a, c, t, g, unknown or other
  misc_feature (361)..(361): n is a, c, g, or t
tcagtgtactactccacgaccggtgctcgatttagtcacgcgagaagggtgagaagtagtggagcctggagcatccccactatggcctgggctccactacttctcaccctcctcgctcactgcacaggttcttgggccaattttctactgactcagccccactctgtgtcggagtcgtccggggaagacggtaaccatctcctgccacccgcagcagtggcacctttgccggcttattatgtgcagtggttccagcagcgccggcngtcncccacagngtgatctatgagactaaccgtcggcctcgtcggtcctcgttcgtttcncgctcntcgacggtcctcactctcncctcctcacntctcgtgactgaacgacgtagacggacgagctacgtactactactcgtactacgttcttagtacgtaactacgacgtagggtcggttcggtcgggacgggacgggacgagtcgtcggtccgtcgtacggtcgacgaccgagcctccgccccgtcgtcctaccgtccgttccgtcccctacccttccgtacgtacgtactacgtacgtcg

SEQ ID NO: 71456 - DNA, 726 bp, Homo sapiens
  misc_feature: GYAE6OF02GNOC6.16.66.F11.1.454.CMB.1.raw
  modified_base (206)..(206): a, c, t, g, unknown or other
  misc_feature (206)..(206): n is a, c, g, or t
  modified_base (519)..(519): a, c, t, g, unknown or other
  misc_feature (519)..(519): n is a, c, g, or t
  modified_base (717)..(717): a, c, t, g, unknown or other
  misc_feature (717)..(717): n is a, c, g, or t
tcagtgtactactccacgaccggtgctcgatttagtcacgcgagaagggtgagaagtagtggagcctggagcatcccactatggcctgggctccactactctcaccctctcgctcactgcacagttctggccaattttcactgactcagccccatctgtgtcggatcgtccggggaagaccggtaaccatctcctaggccacccgnacgcaggtggcctaccgtttggccgtactattatgtgctagttcgggttaccaggctaggccggtccggggactacggtccgccccccgaaccaggacggtagtactaccgtagtcggaacggtaactaaccgtaccggccctgtccggggttccctccgttcggttttacgcgtcctacgacgtcggtaccggttcctaccctacgtaccgtccggtaccccttcccgtactacctacgtttcctacgtacggtacgttaacgaacgtaccggtgaccggacggacgtccgtagtacctacttacgtcggtnttacgtcttagtacgtactaacgtccgggtagggtacggttcgggtccggggtaaccgggtaacggaaccgtaaggtccgttccgggtaccggttcctaaggtcccacggtacccgaggtcctacccggtccccgttacggccttacccgtccgttccccggtccgttaacccctcgtttaaggaccgttagtacccnggtaccggg

SEQ ID NO: 71457 - DNA, 190 bp, Homo sapiens
  misc_feature: GYAE6OF01EWEV6.13.85.H08.1.454.CMB.1.raw
  modified_base (187)..(190): a, c, t, g, unknown or other
  misc_feature (187)..(190): n is a, c, g, or t
tcagtcacgtactacacgaccggtgctcgatttagtatcactcagtcgcgggccaacagtgatgaccattgggtgttcggcggagggaccaagctgaccgtcctaggtcagcccaaggctgcccctcggtcactctgttcccaccctcctctagtacgtgactgagcgggctggcaaggcgcatagnnnn

SEQ ID NO: 71458 - DNA, 190 bp, Homo sapiens
  misc_feature: GYAE6OF01CKYQA.13.85.H08.1.454.CMB.1.raw
  modified_base (188)..(190): a, c, t, g, unknown or other
  misc_feature (188)..(190): n is a, c, g, or t
tcagtcacgtactacacgaccggtgctcgatttagtatcactcagtcgcgggccaacagtgatgaccattgggtgttcggcggagggaccaagctgaccgtcctaggtcagcccaaggctgccccctcggtcactctgttcccaccctcctctagtacgtgactgagcgggctggcaaggcgcatagnnn

SEQ ID NO: 71459 - DNA, 191 bp, Homo sapiens
  misc_feature: GYAE6OF01BHN91.13.85.H08.1.454.CMB.1.raw
  modified_base (178)..(178): a, c, t, g, unknown or other
  misc_feature (178)..(178): n is a, c, g, or t
  modified_base (184)..(191): a, c, t, g, unknown or other
  misc_feature (184)..(191): n is a, c, g, or t
tcagtcacgtactacacgaccggtgctcgatttagtatcactcagtacgcgggccaacagtgatgaccattgggtgttcggcggagggaccaagctgaccgtcctaggtcagcccaaggctgcccctggtcactctgttcccgcctctctagtacgtgactgagcgggctggcaggcncatagnnnnnnnn

SEQ ID NO: 71460 - DNA, 189 bp, Homo sapiens
  misc_feature: GYAE6OF02IVM51.13.85.H08.1.454.CMB.1.raw
  modified_base (187)..(189): a, c, t, g, unknown or other
  misc_feature (187)..(189): n is a, c, g, or t
tcagtcacgtactacacgaccggtgctcgatttagtatcactcagtcgcgggccaacagtgatgaccattgggtgttcggcggagggaccaagctgaccgtcctaggtcagcccaaggctgcccctcggtcactctgttcccgccctcctctagtacgtgactgagcgggctggcaaggcgcatagnnn

SEQ ID NO: 71461 - DNA, 186 bp, Homo sapiens
  misc_feature: GYAE6OF02IE2B0.13.85.H08.1.454.CMB.1.raw
  modified_base (186)..(186): a, c, t, g, unknown or other
  misc_feature (186)..(186): n is a, c, g, or t
tcagtcacgtactacacgaccggtgctcgatttagtatcactcagtcgcgggccaacagtgatgaccattgggtgttcggcggagggaccaagctgaccgtcctaggtcagcccaaggctgcccctcggtcactctgttcccgcctcctctagtacgtgactgagcgggctggcaaggcgcatagn

SEQ ID NO: 71462 - DNA, 270 bp, Homo sapiens
  misc_feature: GYAE6OF02JCJW2.13.85.H08.1.454.CMB.1.raw
  modified_base (266)..(270): a, c, t, g, unknown or other
  misc_feature (266)..(270): n is a, c, g, or t
tcagtcacgtactacacgaccggtgctcgatttagtatcactcagtcgcgggataatagtcacaactggaacggcgttttggggtggtggttcgaccctggggccagggaaccctggtcacagtctcctcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnn

SEQ ID NO: 71463 - DNA, 272 bp, Homo sapiens
  misc_feature: GYAE6OF02HF4YE.13.85.H08.1.454.CMB.1.raw
  modified_base (266)..(272): a, c, t, g, unknown or other
  misc_feature (266)..(272): n is a, c, g, or t
tcagtcacgtactacacgaccggtgctcgatttagtatcactcagtcgcgggataatagtcacaactggaacggcgttttggggtggtggttcgacccctgggccagggaaccctggtcacagtctcctcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnnnn

SEQ ID NO: 71464 - DNA, 274 bp, Homo sapiens
  misc_feature: GYAE6OF02HFDOH.13.85.H08.1.454.CMB.1.raw
  modified_base (267)..(274): a, c, t, g, unknown or other
  misc_feature (267)..(274): n is a, c, g, or t
tcagtcacgtactacacgaccggtgctcgatttagtatcactcagtcgcgggataatagtcacaactggaacggcgttttggggtggtggttcgacccctggggccagggaaccctggtcacagtctcctcagcctccaccaagggcccatcggtcttcccctggcgccctgctccaggagcacctccgagagcacagcggccctgggctgcctggtcaaggactacttcctagtacgtgactgagcgggctggcaaggcgcatagnnnnnnnn

SEQ ID NO: 71465 - DNA, 512 bp, Homo sapiens
  misc_feature: GYAE6OF01AIH7G.44.59.F04.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (490)..(490): a, c, t, g, unknown or other
  misc_feature (490)..(490): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnaggcccctaaggtcctcgtctctcgtgaaaccngactggaaggtagagtcccgtcaggttcagtgccagtccaggtggtgggccggagtccactctcaccattagcgacctgcgctgaagattctgctaacttatttctgtcagcagtatcatagtcgcccgttctacttttggccaggggaccaagctaggaatcaaacgactgtggctgcacntctgtcttcatcttcccncntc

SEQ ID NO: 71466 - DNA, 530 bp, Homo sapiens
  misc_feature: GYAE6OF01EOMN0.44.59.F04.1.454.CMB.1.raw
  modified_base (274)..(274): a, c, t, g, unknown or other
  misc_feature (274)..(274): n is a, c, g, or t
  modified_base (306)..(306): a, c, t, g, unknown or other
  misc_feature (306)..(306): n is a, c, g, or t
  modified_base (505)..(505): a, c, t, g, unknown or other
  misc_feature (505)..(505): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaggggnaggccctaaggtcctcgtctctcgtgaaaccngactggaaggtagagtcccgtcaggttcagtgccagtccaggtggtgggccggagtccactctcaccattagcgacctgcggcctgaagattctgctaacttattctgtcagcagtatcatacgtcgtccccgttctaccgttttggacccgagggggtaccaaggcttaggaaactacgaaacgactgtggctgcacntctgtcttcactccttcccgctatc

SEQ ID NO: 71467 - DNA, 518 bp, Homo sapiens
  misc_feature: GYAE6OF01BGCCQ.44.59.F04.1.454.CMB.1.raw
  modified_base (274)..(274): a, c, t, g, unknown or other
  misc_feature (274)..(274): n is a, c, g, or t
  modified_base (321)..(321): a, c, t, g, unknown or other
  misc_feature (321)..(321): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (420)..(420): a, c, t, g, unknown or other
  misc_feature (420)..(420): n is a, c, g, or t
tcagacagtatatacacgaccggtgctcgatttagtacacacacttagggattggggcatgagtcagtctcagtcaggacacagcatgcacatgagggtcccgctcagctcctggggctcctgctactctggctccgaggtgccagatgtgacatccagatgacccagtctccatcctccctgtctgcatctgtcggagacagagtcaccatcacttgccggcaagtcagagcattaggaactctttaaatggtatcagcagagaccagggaancccctgaactcctgatctctgctgcctcactctgcaaggtgagtctntcaagttcagtgcngtgatcgnggacagtatttcactctcacctatctcctagtctcgacaactgaagtattttgacctaactttactacttgtacaanacgtaagttactacgtcgtccccgttacgttacgttttcgggaccggggtaaccaaggtccgtagggtaacgacttaacgaaacgtaacgtggtacgg

SEQ ID NO: 71468 - DNA, 701 bp, Homo sapiens
  misc_feature: GYAE6OF01CPX44.44.59.F04.1.454.CMB.1.raw
  modified_base (248)..(248): a, c, t, g, unknown or other
  misc_feature (248)..(248): n is a, c, g, or t
tcagacagtatatacacgaccggtgctcgatttagtacacacacttagggagttgggggcatgagtcagaccctgtcaggggacagcatggacagtcgagggtccccgctcagcgtcctggggctcctgctgctctggctcccaggttcgagatgtgacatcgagactgacccagtctccttccttctgtcttcttctgttggaggcagcgtcaccatcacttgccgggcgagtcaggtcgtttcggngctgttgaccttaggtttcaaacgtaaaaaggggggcaagggcccctaaagggtcctccggtactcctcgtgaaacctgactggaaggtacgacgttccccgtactagggttacaggttcgcctagtccgtaggtcgggtcggggcccgggtaggtcccacgttcgtaccgaaccagttttacggccgtaacccttggacccggtccttacggaaacggtactttaccgtcggtacctaaacttttacgttttcctacggttacctaggttactaacggttacttacgtaacttacggtcgtaccccgtttataacccgtttttacggacccgtaacgggggtaccctaaggtccgtagggaactacgaaacggtaactcggtacggtaccgtacgactaaccgtgttaccgtcgttaccttctacttccgtttaccccgtcctacgttaccg

SEQ ID NO: 71469 - DNA, 556 bp, Homo sapiens
  misc_feature: GYAE6OF01AYM8D.44.59.F04.1.454.CMB.1.raw
  modified_base (205)..(205): a, c, t, g, unknown or other
  misc_feature (205)..(205): n is a, c, g, or t
  modified_base (524)..(524): a, c, t, g, unknown or other
  misc_feature (524)..(524): n is a, c, g, or t
tcagacagtatatacacgaccggtgctcgatttagtacacacacttagggattggggagcttcagctgtggtagagaagacaggattcaggacaatctccagcatggccggcttccctctcctcctcaccctcctcactcactgtgcagggtcctgggcccagtctgtgctgactcagccatcctcagcgtctgggacccccggnagacggtcacgatcttttgtctggaagttaggtccaacatcggaagttaattacgtatactggtatcggcaattcacaggagcggtccccagacccctcatctatagggagaatcagcggccctcgacggggtcccctgaccgtattctcgtggctccaagtctggccacctcacgtccctccctggcccatccacgtcgggcctccgaggctagaagacgtggagggtgtattatacgtcgcctagtcctatgacagcacgcctcgtaggtggttgggtggttcgggcgggacggaccgagtcgtcggaccgttccgnggtcgacgaccgaaggcctccggccccgtcgg

SEQ ID NO: 71470 - DNA, 534 bp, Homo sapiens
  misc_feature: GYAE6OF01EIHHQ.44.59.F04.1.454.CMB.1.raw
  modified_base (275)..(275): a, c, t, g, unknown or other
  misc_feature (275)..(275): n is a, c, g, or t
  modified_base (442)..(442): a, c, t, g, unknown or other
  misc_feature (442)..(442): n is a, c, g, or t
  modified_base (502)..(502): a, c, t, g, unknown or other
  misc_feature (502)..(502): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggngaggccctaaggtcctcgtctctcgtgaaaccagactggaaggtagagtcccgtcaggttcagtgccagtccaggtggtgggccggagtccactctcaccattagcgacctgcggcctgaagattctgctaacttatttctgtcagcagtatcatagtctcccgttntactttggccgaggggtaccaagctaggaactcgaaacgtaacgtgtaggtctgcacctntcctgttccttcacttccttcccgcctatccg

SEQ ID NO: 71471 - DNA, 548 bp, Homo sapiens
  misc_feature: GYAE6OF01AOCZY.44.59.F04.1.454.CMB.1.raw
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaagggggnaggccctaaggtcctcgtctctcgtgaaaccagactggaaggtagacgtcccgtcaggttcagtgccagtccaggtggtgggccggagtccactctcaccattacgcgacctgcggcctagaagattctgactaactttattctgtcagcagtatcatacgttcgccccgtttctacgttttcgggcccgtagggggaccaaggtctaggaaactcgaaacgtactggtggcctcgacactactctgttcttcacttcccttcccgcctatccg

SEQ ID NO: 71472 - DNA, 580 bp, Homo sapiens
  misc_feature: GYAE6OF01B31MG.44.59.F04.1.454.CMB.1.raw
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctccgtcctcactgtctgcgtctattggggacagagtcaccatccttaaaagccgggcgagtgccgacattaggacttttttggcctggtttcagcaggagcctggcaaagcccctaagtcccctgatcttttctggatccactttgaagagtggagtcccagccaggttcagcgcagtggttctgggacacgtattcactctcaccatcagcagcctgcagcctggagtatttcgcgtacttattactgaccaactaattattactttttatccgtaactagttttacggaccgtaggggacctaagccgtaggaagtagttaccgaaaaggtaaccttggtacggtactcggacctaacccgtagttacccgttacggttacctttacctaacgttcccgtttacccccgg

SEQ ID NO: 71473 - DNA, 534 bp, Homo sapiens
  misc_feature: GYAE6OF01ASMPQ.44.59.F04.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (508)..(508): a, c, t, g, unknown or other
  misc_feature (508)..(508): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnaggcccctaaggtcctcgtctctcgtgaaaccngactggaaggtagagtcccgtccaggttcagtgccagtccaggtggtgggccgagtccactctcaccattagcgacctgcggcctgaagattctgctaacttatttctgtcagcagtatcatagtcgtccccgtttctacttttgggcccgaagggggtacccaagtctaggaaactcgaaacgactggtggctgcaccntctgttccttcactccttcccgcatc

SEQ ID NO: 71474 - DNA, 515 bp, Homo sapiens
  misc_feature: GYAE6OF01C6NEB.44.59.F04.1.454.CMB.1.raw
  modified_base (275)..(275): a, c, t, g, unknown or other
  misc_feature (275)..(275): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagagtcccgtccaggttcagtgccagtccaggtggtgggccggagtccactctcaccattagcgacctgcggcctgaagattctgcaacttatttctgtcagcagtatcatagtgccccgttcacttttggcctaggggaccaagctaggaatcaaacgaactgtggctgcacatctgtcttcatcttcccncntc

SEQ ID NO: 71475 - DNA, 582 bp, Homo sapiens
  misc_feature: GYAE6OF01AKOPB.44.59.F04.1.454.CMB.1.raw
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagacagtatatacacgaccggtgctcgatttagtacacacacttagggattggggagagaagacaggattcaggacaatcttcatcatgacctgctcccctctcctcctcacccttctcattcactgcacagggtcctgggcccagtctgtgttgacgcagccgccctcagtgtctgcggccccaggacagagggtcaccatctcctgctctggaagaacctccaatgttaggaaataattatgtatcctggtaccagcaactcccaggagcacgcccccaaactcctcatttatgacaataataagcgaccctnagggattccngaccgtattctctggctccaagtctggcacgtcagcccacccgtggccatccacccggactccgagaccgtggggaccgacgggcccgtaagttacttacgtggaccgggtaacggtgggaactacggcgaacgcctggacgtcgcgttcgggattcgtaggtcgttcgggcggagggaccgagggtcgaccgtccgtaagtccacggcccgaaggcctccggcccccgtggtaccacgtccgtcgttacccccg

SEQ ID NO: 71476 - DNA, 638 bp, Homo sapiens
  misc_feature: GYAE6OF01ARMRD.44.59.F04.1.454.CMB.1.raw
tcagacagtatatacacgaccggtgctcgatttagtacacacacttagggattggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcgaggttcgtttcggtgctgttcgccgttggtttcaaacgaaaaagggggagacggccccgtaaggtcctcgtctcgtcgtagaaaccagactaggaaggtagacggtcccgtcgaggttcagtgccagtccaggtgggtcgggccggagtccgactcgtcacctattacgcgacctggccggcctagaacgattctgacctaactttatttctgtacagctagtatcattagtccgtccccgttctacgtttttcggacccgtacgggggtaacccgtaagtcgtagggaaactaccgaaaaccgtaaccgtggtacgggtccgtcggaccctaacctaacgttcccgtttacggtttcccgtttaccgtaactttccctttccccccggtaccctaacgttacccgg

SEQ ID NO: 71477 - DNA, 514 bp, Homo sapiens
  misc_feature: GYAE6OF01BQKJ8.44.59.F04.1.454.CMB.1.raw
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (309)..(309): a, c, t, g, unknown or other
  misc_feature (309)..(309): n is a, c, g, or t
  modified_base (443)..(443): a, c, t, g, unknown or other
  misc_feature (443)..(443): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaaacgaaaagggggnaggcccctaaggtcctcgtctctcgtgaaaccngactggaaggtagagtcccgtcaggttcagtgccagtccaggtggtgggccggagtccactctcacattagcgacctgcggcctgaagattctgctaacttatttctgtcagcagtatcatagtcgccccgttnacttttggccaggggaccaagctaggaatcaaacgactgtgctgcacntctntcttcacttctcccncntc

SEQ ID NO: 71478 - DNA, 517 bp, Homo sapiens
  misc_feature: GYAE6OF01B0KRL.44.59.F04.1.454.CMB.1.raw
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (307)..(307): a, c, t, g, unknown or other
  misc_feature (307)..(307): n is a, c, g, or t
  modified_base (391)..(391): a, c, t, g, unknown or other
  misc_feature (391)..(391): n is a, c, g, or t
  modified_base (491)..(491): a, c, t, g, unknown or other
  misc_feature (491)..(491): n is a, c, g, or t
  modified_base (514)..(514): a, c, t, g, unknown or other
  misc_feature (514)..(514): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggngctgttgcctggtttcaacaaaaagggggnaggcccctaaggtcctcgtctctcgtgaaaccngactggaaggtagagtcccgtcaggttcagtgccagtccaggtggtgggccggagtccactctcacattagcgactgcgctganattctgcaacttatttctgtcagctagtatcatgtcgtcccgttcacttttggaccgtaggggaccaagctaggaactcaaacgtactgtggctgacacntctgtcttcacttccttcccgcntcg

SEQ ID NO: 71479 - DNA, 519 bp, Homo sapiens
  misc_feature: GYAE6OF01CTHN4.44.59.F04.1.454.CMB.1.raw
  modified_base (271)..(271): a, c, t, g, unknown or other
  misc_feature (271)..(271): n is a, c, g, or t
  modified_base (489)..(489): a, c, t, g, unknown or other
  misc_feature (489)..(489): n is a, c, g, or t
  modified_base (517)..(517): a, c, t, g, unknown or other
  misc_feature (517)..(517): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaagtagagtcccgtccaggttcagtgccagtccaggtggtgggccggagtccactctcaccatagcgacctgcgctgagtattctgcaacttatttctgtcagcagtatcatagtcgtccccgtttcacttttcggccaggggaccaagctaggaaatcaaacgactgtggctgcaccntctgtcttcactccttcccgccatctgnta

SEQ ID NO: 71480 - DNA, 543 bp, Homo sapiens
  misc_feature: GYAE6OF01BGM0U.44.59.F04.1.454.CMB.1.raw
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
  modified_base (446)..(446): a, c, t, g, unknown or other
  misc_feature (446)..(446): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttcttcctgtcttcttctgttggaggcagcgtcaccatcacttgccgggcagtcaggtcgttttcggngctgttgccttggtttcaacgaaaaaggggganaggcccctaaggtcctcgtctctcgtagaaaccagactggaaggtagacgtcccgtcaggttcagtgccagtccgaggtggtgggccggagtccactctcatcattagcgactgcgctgaagattctgctaacttatttctgtcagctagtatcatagtcgccccgtttntaccttttggacctaagggggaccaagcgtaggaaactccgaaaacgacgtggtacggctaggccaccattctgttcttcacttccttcccgctacg

SEQ ID NO: 71481 - DNA, 537 bp, Homo sapiens
  misc_feature: GYAE6OF01DJTNR.44.59.F04.1.454.CMB.1.raw
  modified_base (244)..(244): a, c, t, g, unknown or other
  misc_feature (244)..(244): n is a, c, g, or t
  modified_base (399)..(399): a, c, t, g, unknown or other
  misc_feature (399)..(399): n is a, c, g, or t
  modified_base (532)..(532): a, c, t, g, unknown or other
  misc_feature (532)..(532): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaacaaaaagggggagaggcccctaaaggtcctcgtctctcgtgaaaccagactggaaaggtagagtcccgtccaggttcagtgccagtccaggtgtgggccggagtccactctcaccattagcgactgcggcctgaagnttctgcaacttatttctgtcagcagtatcatagtcgcccgttcacttttggccaaggggacccaagccttagggaaactcgaaaacgtaactgtggctcgacactaatctgtacttcaattccttcccgcctntaccg

SEQ ID NO: 71482 - DNA, 601 bp, Homo sapiens
  misc_feature: GYAE6OF01B0S42.44.59.F04.1.454.CMB.1.raw
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (414)..(414): a, c, t, g, unknown or other
  misc_feature (414)..(414): n is a, c, g, or t
  modified_base (449)..(449): a, c, t, g, unknown or other
  misc_feature (449)..(449): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttcttcctgtcttcttctgttggaggcagcgtcaccatcacttgccgggcagtcagggttcgttttcggngctgttgcctggtttacaaacgaaaagggggnacggcccctaaggtcctcgtctctcgtagaaaccagactggaaggtagacgtcccgtcaggttcagtcgccagtccgaggtggtcgggccggatccactctcactatagcgactgcgctgagattctgctaactttnttctgtcagctagtatctatacgtcgtcccctttntacgttttcggacccgaagggggtacccaaaggtcgtaaggaaacttccgaaaacggtacttggtacggccgttacggacccacccttaagttcccgttagtttaccctttacctaccgtttacccctttcccccggtacccttagttcccg

SEQ ID NO: 71483 - DNA, 705 bp, Homo sapiens
  misc_feature: GYAE6OF01C67MI.44.59.F04.1.454.CMB.1.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacgttgccgggcagtcgtagggttccgttttcggngtcttgttcgtccttggtttacaaaacggaaaaagggggngacggtacccctaaggtcctcgtcttcgtcgtagaaaccagacgtaggaaggtagacgtcccgtacaggttcagtcgccagtccgaggtggtcgggaccgacgtccactcacaacctagttacgccgtaccgtcggccggacctagaacgtagttcctgtaccttaacgtttattttcgacgttacgaacgtactaacgttataccgtaagttacggtccgtcccccgtttactaaccggttttcgggacccggtaacgggggaaccctaagggtaccgttaaagggtaaactaaccggtaaaaacgtaccgttagggttacggccgtaaccggtaccctaacccgttacgtttccgttacggtttaccctttacccgtaactttcccccgtttccccgtaccgtaacgtttaccg

SEQ ID NO: 71484 - DNA, 520 bp, Homo sapiens
  misc_feature: GYAE6OF01EUX3F.44.59.F04.1.454.CMB.1.raw
  modified_base (276)..(276): a, c, t, g, unknown or other
  misc_feature (276)..(276): n is a, c, g, or t
  modified_base (444)..(444): a, c, t, g, unknown or other
  misc_feature (444)..(444): n is a, c, g, or t
  modified_base (517)..(517): a, c, t, g, unknown or other
  misc_feature (517)..(517): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggngaggccctaaggtcctcgtctctcgtgaaaccagactggaaggtagagtcccgtccaggttcagtgccagtccaggtggtgggccggagtccactctcaccattagcgacctgcggcctgaagtattctgctaacttatttctgtcagcagtatcatgtcgcccgttnacttttggccaggggaccaagctaggaatcaaacgtaactgtgctgacacatctgtccttcatccttcccgcngtc

SEQ ID NO: 71485 - DNA, 550 bp, Homo sapiens
  misc_feature: GYAE6OF01EXBJH.44.59.F04.1.454.CMB.1.raw
  modified_base (337)..(337): a, c, t, g, unknown or other
  misc_feature (337)..(337): n is a, c, g, or t
tcagacagtatatacacgaccggtgctcgatttagtacacacacttagggattgggggcatgagtcagaccctgtcaggggacagcatggacatgagggtcccccgctcagctcctggggctcctgctgctctggctcccaggttcgagatgtgacatcgagatgacccagtctccttccttcctgtcttcttctgttggaggcagcgtcaccatcacttgccgggcaagtcagagcattaggaactctttaaattggtatcagcagaggccagggaaagcccctcaactcctgatctatgctgcgtcattttgcaaagtgggtcccatcaaggttnagtggcagtggatctgggacagatttcactctcaccatcagcagtctgcaacctgaagatttcgctagtcttattattgtactaacagtagtagaactaatactaccccgtactccgtaccgttttcgggaccgggtaacggggtacccaagtttggtaggggtaacgtaataaccgtaaaaccgtaacgttaggtacggtcgtggtaacccg

SEQ ID NO: 71486 - DNA, 512 bp, Homo sapiens
  misc_feature: GYAE6OF01ET17L.44.59.F04.1.454.CMB.1.raw
  modified_base (275)..(275): a, c, t, g, unknown or other
  misc_feature (275)..(275): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagagtcccgtccaggttcagtgccagtccaggtggtgggccgagtccactctcacattagcgacctgcggcctgaagattctgcaacttatttctgtcagcagtatcatagtgcccgttcacttttggcctaggggaccaagctaggaactcaaacgaactgtagctgcacntctgtcttcatcctccgcntc

SEQ ID NO: 71487 - DNA, 605 bp, Homo sapiens
  misc_feature: GYAE6OF01CUMDH.44.59.F04.1.454.CMB.1.raw
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaacgaaaaaggggngaggccctaaggtcctcgtctctcgtagaaaccngactggaaggtagagtcccgtcaggttcagtgccagtccgaggtggtgggccggagtccactcncacattagcgactgcgctgaagnttcngacaactttattctgtcagctagtatcatacgtcgtccccgttctaacgttttcgggccctaagggggtacccaaaggtccgttaaggaaacttaccgaaaaaccggtaacctgggtacgggaccgttcggaccctaacctaacgttccgttcgtttaccctttaccaactttccccgtttaccccccggaccttaacgttacccg

SEQ ID NO: 71488 - DNA, 532 bp, Homo sapiens
  misc_feature: GYAE6OF01ENM5J.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (508)..(508): a, c, t, g, unknown or other
  misc_feature (508)..(508): n is a, c, g, or t
  modified_base (529)..(529): a, c, t, g, unknown or other
  misc_feature (529)..(529): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggnaggccctaaggtcctcgtctctcgtgaaaccagactggaaggtagagtcccgtcaggttcagtgccagtccaggtggtgggccggagtccactctcaccattagcgacctgcggcctgaagtattctgctaacttatttctgtcagtcagtatcatagtcgtccccgttctacgttttcggccgagggggtaccaagtcgtaggaaactacgaaacgtactgtggctgccacntctgtcttcatccttcccgcnttc

SEQ ID NO: 71489 - DNA, 630 bp, Homo sapiens
  misc_feature: GYAE6OF01CGL88.44.59.F04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (279)..(279): a, c, t, g, unknown or other
  misc_feature (279)..(279): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtcctccttccttcctgtcttcttctgttggaggcagcgtcaccatcacttggccgggngagtcaggttcgtttcggncttgttgccttggtttacaacgaaaaaggggngacggcccctaaggtcctcgtctctcgtgaaaccagactggaaggtagagtcccgtcaggttcagtgccagtccaggtggtgggaccggagtccactctacacctattacgcgaccgtttcggccttagaagtacgttctgtacctaactttatttcgtagtctagcctagtactctatacgttcgtaccccgtttctacgttttcggaccgtaacggggaccctaaaggccttaagggaaacttacaaaacggaaccgttaggtacgggccttacggcctaacctacgttccgttaacgttccgttttaccaaccgtttcccgtttcccccgcccttagttccgttaacg

SEQ ID NO: 71490 - DNA, 572 bp, Homo sapiens
  misc_feature: GYAE6OF01E09N7.44.59.F04.1.454.CMB.1.raw
  modified_base (245)..(245): a, c, t, g, unknown or other
  misc_feature (245)..(245): n is a, c, g, or t
  modified_base (278)..(278): a, c, t, g, unknown or other
  misc_feature (278)..(278): n is a, c, g, or t
  modified_base (533)..(533): a, c, t, g, unknown or other
  misc_feature (533)..(533): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttcaaacgaaaaagggggnacggcccctaaggtcctcgtctctcgtagaaaccagactggaaggtagacgtcccgtcaggttcagtgccagtccaggtggtgggccggagtccactctacacctattagcgacctgcggcctgaagtattctgactaactttatttctgtcagtctagtatcatacgtcgtccccgttctacgttttcggaccgtaggggtaccaaggtctagggaaactacgaaaacgtacgttcggtaggctagctaacctnttccgtgttccttcacttcccttccccgtcctagttccg

SEQ ID NO: 71491 - DNA, 542 bp, Homo sapiens
  misc_feature: GYAE6OF01C6F32.44.59.F04.1.454.CMB.1.raw
  modified_base (243)..(243): a, c, t, g, unknown or other
  misc_feature (243)..(243): n is a, c, g, or t
  modified_base (379)..(379): a, c, t, g, unknown or other
  misc_feature (379)..(379): n is a, c, g, or t
  modified_base (438)..(438): a, c, t, g, unknown or other
  misc_feature (438)..(438): n is a, c, g, or t
  modified_base (515)..(515): a, c, t, g, unknown or other
  misc_feature (515)..(515): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagacagtatatacacgaccggtgctcgatttagtacacacacttagggattgggggcatgagtcagaccctgtcaggggacagcatggacatgagggtccccgctcagcttctggggctcctgctgctctggctcccaggttcgagatgtgacatcgagatgacccagtctccttccttctgtcttcttctgttggaggcagcgtcaccatcacttgccgggcagtcaggttcgtttcggngctgttgcctggttacaaacgaaaaagggggagacggacccctaaggtcctcgtctctacgtgaaaccagactggaaggtagacgtcccgtcaaggttcagtcgccgagtccgaggtggtgggcggagtccactcncaccatagcgactgcgctgaacgtattcgtgactaactttattcgtgtacagcagttanctaattacgtcgtccccgttatacttttgggacgtaagggggaccaagcgtaaggaactacgaaacgtactggtgcngacacatctgtctcatcctcccncntc

SEQ ID NO: 71492 - DNA, 591 bp, Homo sapiens
  misc_feature: GYAE6OF01B18X7.44.59.F04.1.454.CMB.1.raw
  modified_base (276)..(276): a, c, t, g, unknown or other
  misc_feature (276)..(276): n is a, c, g, or t
  modified_base (451)..(451): a, c, t, g, unknown or other
  misc_feature (451)..(451): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggnaggcccctaaggtcctcgtctctcgtgaaaccagactggaaggtagagtcccgtcaggttcagtgccagtccgaggtggtgggccggagtccactctcacctattacgcgacctggcggcctgaagattctgctaacttatttctgtcagctagtatcatacgtcgtccccgttntacgttttcggccgtagggggtaccctaaaggtccgttagggaaactacgaaaacggtaaccgttggtacggcgttcggacctaaccctattccgttgttacccgtttacactttcccgtttccccgtcctacgttaccg

SEQ ID NO: 71493 - DNA, 574 bp, Homo sapiens
  misc_feature: GYAE6OF01DXHW6.44.59.F04.1.454.CMB.1.raw
  modified_base (278)..(278): a, c, t, g, unknown or other
  misc_feature (278)..(278): n is a, c, g, or t
  modified_base (408)..(408): a, c, t, g, unknown or other
  misc_feature (408)..(408): n is a, c, g, or t
  modified_base (412)..(412): a, c, t, g, unknown or other
  misc_feature (412)..(412): n is a, c, g, or t
  modified_base (536)..(536): a, c, t, g, unknown or other
  misc_feature (536)..(536): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttacaaacgaaaaagggggngaggcccctaaggtcctcgtctctcgtagaaaccagactggaaggtagacgtcccgtcaggttcagtcgccagtccgaggtggtcgggccggagtccactctcaccattacgcgacctgccggctgaagnttcngtactaactttatttcgtgtcagctagtatactattacgtcgtccccgtttctacgttttcgggaccgtaggggacccaaggtctaggaaactacgaaacgtacgtggtggcgtacgcaacctntccttgttaccttcacttcccttccccgcctagttccg

SEQ ID NO: 71494 - DNA, 558 bp, Homo sapiens
  misc_feature: GYAE6OF01A8EI9.44.59.F04.1.454.CMB.1.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (527)..(527): a, c, t, g, unknown or other
  misc_feature (527)..(527): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgccttggtttacaaacgaaaaagggggngacggcccctaaggtcctcgtctctcgtgaaaccagactggaaggtagagtcccgtccaggttcagtgccagtccgaggtggtgggccggagtccactctcacctattacgccgacctggccggcctgaagtacttctcgactaactttatttctgtcagctagtatcatacgtcgtccccgttctacgttttcggcccgaggggtaccagcgtaggaactacgaaacgtacgtgtggctcgcaccnttctgttccttctacttccttcccgctctcg

SEQ ID NO: 71495 - DNA, 607 bp, Homo sapiens
  misc_feature: GYAE6OF01B3ET8.44.59.F04.1.454.CMB.1.raw
  modified_base (247)..(247): a, c, t, g, unknown or other
  misc_feature (247)..(247): n is a, c, g, or t
  modified_base (277)..(277): a, c, t, g, unknown or other
  misc_feature (277)..(277): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcaggttcgttttcggngctgttgcctggtttcaacaaaaagggggngaggcccctaaggtcctcgtctctcgtgaaaccagactggaaggtagagtcccgtcaggttcagtgccagtccaggtggtgggccgagtccactctcaccattagcgacctgcggcctgaagnttcngctaactttatttctgtcagcagtatcatacgtcgtccccgttctaccgttttcgggcccgtaacgggggtaaccctaaggtccgttaggaaaactaccgaaaaaccggtaacgttcggtagggtccgttacggaccctaaccgtacttcccgttacggttaccctttaccactttcccgtttacccccgtcctaacgttccg

SEQ ID NO: 71496 - DNA, 600 bp, Homo sapiens
  misc_feature: GYAE6OF01AE3OG.44.59.F04.1.454.CMB.1.raw
  modified_base (284)..(284): a, c, t, g, unknown or other
  misc_feature (284)..(284): n is a, c, g, or t
  modified_base (321)..(321): a, c, t, g, unknown or other
  misc_feature (321)..(321): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgtcttgttcgccttgggtttaccaaacgaaaagggggngacggcccctaaggtcctcgtctcgtcgtagaaaccngacgtggaaggtagacgtcccgtcgaggttcagtgccagtccgaggtggtcgggccgagtccactctcacattacgcgacctggccggtcctaggaagtattctgtacctaactttatttcgtgtcagtcagtatctattacgtcgtccccgttcttacgtttacggccgtaacggggacctaagtcgtaggaactaccgaaacgaccgttaggtacggtcctcgacccaaccgtcttccgttacgttccttaccacttcccttccccgaccttgtccg

SEQ ID NO: 71497 - DNA, 549 bp, Homo sapiens
  misc_feature: GYAE6OF01AWZ3O.44.59.F04.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggnacggccctaaggtcctcgtctctcgtgaaaccngactggaagtagagtcccgtcaggttcagtgccagtccgaggtggngggccggagtccactctcacattagcgacctgcggctgagattctgctaacttattctgtcagcagtactcatagtcgccccgttctacgttttcggccgtacgggggtaccaagtcgtaggaaactaccgaaacgtaacgtggtcggcgtcgaccaccatcctgttccttctacttccttccccgcctattccg

SEQ ID NO: 71498 - DNA, 527 bp, Homo sapiens
  misc_feature: GYAE6OF01AZQJM.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (437)..(437): a, c, t, g, unknown or other
  misc_feature (437)..(437): n is a, c, g, or t
  modified_base (497)..(497): a, c, t, g, unknown or other
  misc_feature (497)..(497): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggnaggcccctaaggtcctcgtctctcgtgaaccagactggaaggtagacgtcccgtcaggttcaggtgccagtccaggtggtgggccggagtccactctcacatagcgactgcgctgantcngctaacttattctgtcagcagtatctatagtcgtccccgttntacgtttggccaggggtaccaagcgtaggaactcgaaacgtactggtggctagcctaccntcgtgttccttcacttccttcccgctcttc

SEQ ID NO: 71499 - DNA, 680 bp, Homo sapiens
  misc_feature: GYAE6OF01BW00C.44.59.F04.1.454.CMB.1.raw
  modified_base (200)..(200): a, c, t, g, unknown or other
  misc_feature (200)..(200): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (612)..(612): a, c, t, g, unknown or other
  misc_feature (612)..(612): n is a, c, g, or t
  modified_base (625)..(625): a, c, t, g, unknown or other
  misc_feature (625)..(625): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccgaggttcgagatgtgacatcgagatgacccagtcctccttcctctgtcttcttctgtgagnagctcacatcacgttggccggngagtcgaggttcgtttggngcttgttcgccgttggtttacaaaacggaaaaggggtcgaccggtaccctaaggtccctcgtctcgtacggtacgaaaccgtagacgtaggaacggtacgtacgtcccgtacgtaggttcagtcgccgtagtccgagggtcgggtcggaccggtacgtccgtaactcgtaccaaccgtacgttacgccgtaccgtcggaccggtcctaggaacgttatttccggtacgtaccttaacttttcgtttactaggttacctagtactagttactactacgttaaggtccgttaccccgttattacggttttaccgggacccggaacggggtaacctaaggtccggtaaagtaaactacccgtaaaagtaccggngttaccggcgtanacccgtactacgttccgttacgttactactacgttcccttcccgacttcgttaac

SEQ ID NO: 71500 - DNA, 684 bp, Homo sapiens
  misc_feature: GYAE6OF01C1RQE.44.59.F04.1.454.CMB.1.raw
  modified_base (174)..(174): a, c, t, g, unknown or other
  misc_feature (174)..(174): n is a, c, g, or t
  modified_base (196)..(196): a, c, t, g, unknown or other
  misc_feature (196)..(196): n is a, c, g, or t
  modified_base (242)..(242): a, c, t, g, unknown or other
  misc_feature (242)..(242): n is a, c, g, or t
tcagacagtatatacacgaccggtgctcgatttagtacacacacttagggattgggggcatgagtcagaccctgtcaggggacagcatggacatgagggtccccgctcagccgtcccggggctcctgctgctctggcctcccgaggttcgagatgtgacatcgagatcgacccngtctccttccttctgtcttctntgtggagcagctcacatcacgttgcggcagtctaggttcgtttggntcttgtcgccgttggttacaaacggaaaaggggcgaccgacccgtaaggtccttcgtctcgtcgaacgaaacgagtaagtggaaggttacgacgttcccgtacgaggttcagtcgaccgtacggtcgagggttcgggcgggtccggtaacgtccctaagtcctacaaccgtagttacgcccgtaacgtcggccggtacgtaggaacgtacttcgtaacgtaccttaaacgtttattttcgacgtaacgaggactagtaactactagtacggtccgtcccgttattacggtttcggaccgaagggaccgtaagtacgtaggtaaaactacgaaaacggtacgtaggtccggtactaccggaaccttaaccctagtttcccgttacgttacccgtttacccgtacgttacccccgttaccccggtacctaaagttcgttaaacg

SEQ ID NO: 71501 - DNA, 678 bp, Homo sapiens
  misc_feature: GYAE6OF01CD3BF.44.59.F04.1.454.CMB.1.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
  modified_base (316)..(316): a, c, t, g, unknown or other
  misc_feature (316)..(316): n is a, c, g, or t
tcagacagtatatacacgaccggtgctcgatttagtacacacacttagggagttggggcatgagtcagaccctgtcagggacagcatggacatgagggtccccgctcagctccgtggggctctgctgctctggctcccaggttcgagatgtgacatcgagatgacccagtcctccttccttcctgtcttcttctgttggagcagctcacatcacgttgccgggnagtcaggttcgttttcgngtctgttgtcctggtttacaaacgtaaaaggggngacggacccgtaaggtcctcgtctcgtcggtacgaaaccnggtacgtaggaacggtagacggttaccccgtcgtaggttcgagttacgccgtacggtccgagggttcgggtcgggccggtacggtcccacgtcctaccactagttacgcgtaccgtggccggtctagaagtacttcgtgtacctaacttttactttcgtagtcagtactaaggttactacctaagttaccggtccgttacccccgtttagttaccggttttacgggacccggaacggggtaaccctaaggtaccgtaagggtaaactaaccggaaaaccgtcgttcggtacggtctaccggtactacccgtagttcccgttgtttacccttcaccgtttacccctacccgtctacgttaccg

SEQ ID NO: 71502 - DNA, 569 bp, Homo sapiens
  misc_feature: GYAE6OF01DJUTH.44.59.F04.1.454.CMB.1.raw
  modified_base (223)..(223): a, c, t, g, unknown or other
  misc_feature (223)..(223): n is a, c, g, or t
  modified_base (277)..(277): a, c, t, g, unknown or other
  misc_feature (277)..(277): n is a, c, g, or t
  modified_base (313)..(313): a, c, t, g, unknown or other
  misc_feature (313)..(313): n is a, c, g, or t
  modified_base (565)..(565): a, c, t, g, unknown or other
  misc_feature (565)..(565): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttcttcctgtcttcttctgtggaggcagctcaccatcacttgccgggngagtcagggttcgttttcggtgcttgttgcctggtttacaaacgaaaagggggngacggcccctaaggtcctgtctctcgtacgaaaccngactggaaggtagacgtcccgtcaggttcagtcgcctagtccaggtggtgggccgagtccacgtctccactattacgcgactgcgctacgagtattcgtgtactaacttatttactgtacagtctaagtatacgtatacgtcgtcccgttctacgttttacggccgtacgggtaccgtaacgcgtaggaactacgaaacgtacgtagtggcgtcgtacactactctgttcttactacttccttcccgtcctnttcg

SEQ ID NO: 71503 - DNA, 610 bp, Homo sapiens
  misc_feature: GYAE6OF01DKUNL.44.59.F04.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
  modified_base (313)..(313): a, c, t, g, unknown or other
  misc_feature (313)..(313): n is a, c, g, or t
  modified_base (329)..(329): a, c, t, g, unknown or other
  misc_feature (329)..(329): n is a, c, g, or t
tcagacagtatatacacgaccggtgctcgatttagtacacacacttagggattgggggagcttcagctgtggtagagaagacaggattcaggacaatctccagcatggccgcttccctctcctcctcaccctcctcactcactgtgcagggtcctgggcccagtctgtgctgactcagccatcctcagcgtcgtcggggacccccggnagacggtcacgattctttgtctggaagtaggtccaanatcggaagtaattacgtatacgtggtatcggacaattcacgaggacgccggtcccccacgaccccctnatctaagtaggggaanatcgagccgccctgacggggtccctgaccgtattcctcgtcgccctccgtaagtcgtcggacctaccctcaccgcccttcccgtggccagtcgacggtcgggccgtccggtacgaggtagtggagtcttgtactttatttcgtgtcggcggtcgttgggatcgactacgttcgtggtagtcgtactcgtacgttcggttcgggcgggtaacggaccgaacgtcgtacggtacccgtaccgtacgtaccgacgacccgacggtccctccggtcccccgtcgg

SEQ ID NO: 71504 - DNA, 593 bp, Homo sapiens
  misc_feature: GYAE6OF01D7YRE.44.59.F04.1.454.CMB.1.raw
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (486)..(486): a, c, t, g, unknown or other
  misc_feature (486)..(486): n is a, c, g, or t
  modified_base (588)..(588): a, c, t, g, unknown or other
  misc_feature (588)..(588): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctcttccttctgtcttctctgttggaggcagcgtcaccatcacttggccgggcgaggtcaggtcgttttcggngctgttcgcttggttacaaacgaaaaggggngacggtccctaaggtcctcgtctcgtcgtacgaaccgagacgtggaaggtagacgtcccgtcaggttcagtgccagtccgaggtgggtgggccggagtcccactcctaccacctagttacgccgaccgttgcggtcctagaacgtcttcgtgaccttaactttactttctgtacacgtacgtagtactctaagtcgtccgtaccccgtttntaccgttttcggaccgacggggtaccaggtctacggaactacgaaacgtacgtgtacggctgacaccgtatccgtgttccttactacttcccttcccgcctnttacg

SEQ ID NO: 71505 - DNA, 872 bp, Homo sapiens
  misc_feature: GYAE6OF01ED98A.44.59.F04.1.454.CMB.1.raw
  modified_base (169)..(169): a, c, t, g, unknown or other
  misc_feature (169)..(169): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccngtctccttccttctgtcttctctgtggagcagcgtcacatcacttggccgggcgagtcgtagggtttcgttttcggtgtcgttgttcgtccgttaggtttaaccgaaaacgggaaaaaggggggacgaaccgggtacccccgttaaggttcccgtccggtcccttacggtaccgttaacggaaacccgtaggtaccggttaaggggtaacgggtacgtaccggttaccccgtacgtacggttacgaggttcgaccgtacggtccgagggttcggggtacggggcccggtacgtcccgacgttccgtaccgaacctagttaccggaccgtacccgttcgggtacccgggtaccgtaaggtaacgttactttccgtacggtaaccctttaaacttttactttaccgttacggtaccgtaacgtaccgtaacggtttacgttaaccgtagtttaaccggttccccggttacccccgttttaccgtttaacccgggtttttaccgggacccgggttaaaccgggggtaaccccgttaaacgggttacccggttaaacgggtaaaccgttaaacccggtaaaaaccggttaaccggttacgggttacgggtacccggttaccggtaaccctaccgttacgtttacccgttcggtttacctttacccgtaactttcccccgtttacccccggtaccttaccgttaccgg

SEQ ID NO: 71506 - DNA, 861 bp, Homo sapiens
  misc_feature: GYAE6OF01D2AHY.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccgaggttcgagatgtgacatcgagatcgacccagtcctccttccttcctgttcttcttctgttggagcagcgtcaccatcacgttggccggcgtagtcgtagggttcgtttttcgggtgtcgttggttcgtccgttagggttttaaccgaaaacgggtaaaaagggggacgtaaccggtacccccgttaaggttcccctcggttccttccgttaccggtaacgaaaacccgtaggacgttagggaaacggttacggtaccgttaccccggttacgtacggtttcacggttacgacccgtaaggtcccggtaagggttcgggtaccggggacccggtacgttccccgtaccgttacctacccgaaccgttaacgttaaccggtacccggtaacccggtttcggacccggggtcccttaacggtaaacggttacctttacggttacgtaacctttaaccgttttacgtttccgtagttaccgtacgtacgttaacgttaaccgttacgtacgtttaaccgggttcccgttacccccgtttaccgttaccggtttttacccgggacccggttaccggggtaacccgtaaacggtaccgtaacggtaaaccgtaaccgtaaaaccggtacgttacggtacggtaccgtaccggacctaacccgtagtttacccgttaccttacccgttacttacccgttaccctttacccccgaccttacgttaccg

SEQ ID NO: 71507 - DNA, 627 bp, Homo sapiens
  misc_feature: GYAE6OF01A2BV7.44.59.F04.1.454.CMB.1.raw
  modified_base (176)..(176): a, c, t, g, unknown or other
  misc_feature (176)..(176): n is a, c, g, or t
  modified_base (184)..(184): a, c, t, g, unknown or other
  misc_feature (184)..(184): n is a, c, g, or t
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (461)..(461): a, c, t, g, unknown or other
  misc_feature (461)..(461): n is a, c, g, or t
  modified_base (584)..(584): a, c, t, g, unknown or other
  misc_feature (584)..(584): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctctctccngtcttctntgttcgacgcagcgtcacagtcactttcgcgggcgaggtcctagggtccttttagggcgctaggttgcctggtttcaaacgtaaaagggggtnaggccctaagggtcctgtactcgtacgtanaaaccagtacctgggaagtacgagttcccgctagggttacaggtgacctaggtaccaggtggtcgggaccgaggttcccaactctacaaccgtgttaacgcggtaacctggacggccttaggaacgtacttcgtcgtacgtaactttactttcnggttaccaggtctaagttactcgtaagtacgtcggtaccccttactcgttttacggaccgaagggtaccaacgtcgttaggaaaactcgtaaaacgtactggtagaccttgacctacgagttntacgtcttacgatcccgtttcccgactattcctgtacgttaac

SEQ ID NO: 71508 - DNA, 632 bp, Homo sapiens
  misc_feature: GYAE6OF01A9KKT.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (446)..(446): a, c, t, g, unknown or other
  misc_feature (446)..(446): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggnaggcccctaaggtcctcgtctctcgtgaaaccagactggaagtagagtcccgtcaggttcagtgccagtccaggtggtgggccggagtccactctcaccattagcgacctgcggcctgaagtattctgctaacttatttctgtcagctagtatcatagtcgtccccgtttntaccgttttgggacccgtacgggggtaccctaaaggtccgttaaggggtaaaacttaccgaaaaaccgggtaaccgttgggtacgggtaccgttacggacccctaaccccgtaagttcccgtttacgtttaccccgtttactaacccgtttccccgttttaccccccggaccttaacgtttacccg

SEQ ID NO: 71509 - DNA, 658 bp, Homo sapiens
  misc_feature: GYAE6OF01BENJ7.44.59.F04.1.454.CMB.1.raw
  modified_base (284)..(284): a, c, t, g, unknown or other
  misc_feature (284)..(284): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcgaggttcgttttcggtgtcttgttcgccgttggtttacaaacgaaaagggggnacggaccctaaggtcctcgtctctcgtacgaaaccagacgtagggaaggtagacgtcccgtcaggttcaggtcgccaggtccgaggtgggtcggggccggacgtccactccgtcacctagttacgccgtacctcggccggtctagaagtattcgtcgactaactttatttctcgtacacgtctacgtactatacgttacgtccgttccccgtttcgttaccgttttcgggacccggtaacggggtaacccgtaacggtaccgtaacggtaaacgtaaccgtaaaacggtaacgttcggtacggtaccgtcggtaccaccgtactaccgttcgttaccgttacctaccgttacccgtttccccgcctcgttaccg

SEQ ID NO: 71510 - DNA, 729 bp, Homo sapiens
  misc_feature: GYAE6OF01D2M6S.44.59.F04.1.454.CMB.1.raw
  modified_base (245)..(245): a, c, t, g, unknown or other
  misc_feature (245)..(245): n is a, c, g, or t
  modified_base (283)..(283): a, c, t, g, unknown or other
  misc_feature (283)..(283): n is a, c, g, or t
  modified_base (685)..(685): a, c, t, g, unknown or other
  misc_feature (685)..(685): n is a, c, g, or t
  modified_base (719)..(719): a, c, t, g, unknown or other
  misc_feature (719)..(719): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtcctccttccttcctgtcttcttctgttggagcagcgtcacatcacttgccgggcgagtcaggttcgttttcggngtcttgttgccgttggtttacaaacgtaaaaagggggngtacggcccgttaaggtcctccgtctcgtacgtacgaaaccagacgtaggaaggtacgacggtccccgtacgtacggttcacggttcgtaccgtacggtaccgaagggtcgggtcggggacccgggtaacgttccctaaccgtcctaccgaaccgtacgtttaacggacccgtaaccgtcggtaccgggtcccgttaaggaaacgttacgtttaccgtacgtaaccgttaaacctttttagtttacctacggttacctaacggtactacggttaatccgtaagttacggttaccgttaccccgtttataccggttttacggaccggtaacggggtaacctaaggttcgtaacggtaacttaaccgaaaacggtacgttggacgtacgtacgaccaaccgttntccgttcgttacctttacactttccccgtacccncgttgttacg

SEQ ID NO: 71511 - DNA, 818 bp, Homo sapiens
  misc_feature: GYAE6OF01CWERP.44.59.F04.1.454.CMB.1.raw
  modified_base (261)..(261): a, c, t, g, unknown or other
  misc_feature (261)..(261): n is a, c, g, or t
  modified_base (360)..(360): a, c, t, g, unknown or other
  misc_feature (360)..(360): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggcctcccaggttcgagatgtgacatcgagatcgacccagtcctccttccttcctgttccttcttctggttaggagcagccgtcacctatccacgttcggccgggcgagtcgtaggtttcgttttcggngtcgttggttcgtccgttaggttaaccgaaaacgggtaaaagggggcgtaccggtaccccgtaaggtccctcgtccgttacgtacggtaacgaaaccgngtaacgtaggtaaacggtacgtaccggttccccgtacgtaaggttccgagttccggacccgtacggtccggtaggggttcgggtcggggacccggtacgttccccgacttacccgtacctaaccgttacgttacggcccggtaccgtcggccggtacctaggtaacgttctttccgtacgtaaccttaaacgttttcgttcgtacgtaccgtacgtacgttaacgttaccgttacgttaacgtttaccggttcccgttacccccccgttttaagtttacccgggttttaccggggaacccgggtaaacggggtaacccctaaacgggtccgttaaacgggtaaactaacccggtaaaccggtacgttgggtacccggaccgttaccgaaccctaccgttacgttccgttacgttacccgttaccttacccgttaccccgtccccgtcttggttacccg

SEQ ID NO: 71512 - DNA, 614 bp, Homo sapiens
  misc_feature: GYAE6OF01D6Z23.44.59.F04.1.454.CMB.1.raw
  modified_base (245)..(245): a, c, t, g, unknown or other
  misc_feature (245)..(245): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttacaacgaaaaagggggtgaggcccctaaggtcctcgtctctcgtagaaaccagactgggaaggtagagtcccgtcaggttcagtcgccagtccaggtggtgggccggagtccacgtctcaccattagcacctgcggcctgaagattctgactaactttatttctgtccagtctagtactctatacgttcgtccccgtttctaaccgtttttcggacccgtaacgggggtaccaaacggcgtaacgggaaacttaccgaaaaccggtaacttcggtagggtaccgttggacctacccgtacttccgtaggtttaccttcctaacttcccgtttccccggtccctacgttacccg

SEQ ID NO: 71513 - DNA, 719 bp, Homo sapiens
  misc_feature: GYAE6OF01B3D0N.44.59.F04.1.454.CMB.1.raw
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggtcgggcgagtcaggttcgttttcggngtcttgttcgtccttggtttacaaacgaaaagggggnacggaccctaaggtcctcgtctctcgtcgaaaccngacgtaggaaggtagacgtcccgtcgtaggttcagtcgccgtacgtccgaggtcgggtcggggcccggtagtccctacgtccgtacctaaccgagttacgccggtaccctggccggtaccgtaggaacgtactttcgtacggtacctaacgttttatttcgtcgttacgacggtactaaggttactacgtaacgttacggttaccgttccccccgttttagttaacccggtttttccggggacccggtaaacggggggtaaccctaaaggttaccgtaacgggtaaaaccttaaccgaaaaaccgggtaacgttcgggtaccgggtacttacgggaccctaacccgtacgttccgttacgttccttaccgtacccttacccgttcccccgactacgttcc

SEQ ID NO: 71514 - DNA, 750 bp, Homo sapiens
  misc_feature: GYAE6OF01EII72.44.59.F04.1.454.CMB.1.raw
  modified_base (740)..(740): a, c, t, g, unknown or other
  misc_feature (740)..(740): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtcctccttccttcctgtcttcttctgttggagcagcgtcaccatcacgttcggccgggcgagtcgtaggttcgttttcggtgtcgttgttcgtccgttaggtttacgaaaacggaaaaagggggcgacggtaccccgttaaggtcccttcgtccgtcgtacggtacgaaaccgagtacgtaggtaacggtacgaccgtcccgtacgtaggttcagtcgccgtacggtccgtagggtcgggtcgggaccggtacgtcccgtacgtccgtacgtaaccgtacgttacggaccgtaccgttcggccggtacctaaggtaacgttcgttaccgtagtaaccctttaaacgttttactttaccgtaggtacctacgtacgtaagttactactaaggttaccggttcccgttacccccgtttacgttaccggttttcgggaacccgtaacgggggtaaccctaaagggtcctaaacgggtaaactaccgaaaacggtacgttcgggtacggtacctcggaaccctaacgttcttaccgttcgttaccctttaccgacgtttccccttacccccgnttacgtaccg

SEQ ID NO: 71515 - DNA, 698 bp, Homo sapiens
  misc_feature: GYAE6OF01B8XDJ.44.59.F04.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (320)..(320): a, c, t, g, unknown or other
  misc_feature (320)..(320): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggtcgttttcggngtctgttgccttggtttacaaacgtaaaaagggggngacggccctaaggtcctcgttctcgtacgtacgaaaaccnggacgtagggaaggtacgacggtccccgtctaggttacaggtcgaccgaggtaccgaggtcgggtggggtccggacgtacactctaccaccgattacggcgaccttcggcggtacctaggaagtactttccgtagtaacctaaacgttttacttttcgtacggttacaagtctaaggttactacgtaagtttacggttaccggttacccccgtttacgtttaccggttttacgggaccccgtaaggggggtaaccctaaagggtccgttaagggtaaaatacccgaaaaacgggtaaacttcgggtaggaccgtacgaccaaccgtaattccgtagttcccttacggtacttacccttcccccggtactacgttaccg

SEQ ID NO: 71516 - DNA, 745 bp, Homo sapiens
  misc_feature: GYAE6OF01DJFMJ.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcaccatcacgttcgccggcgagtctaggttcgttttcggtgcttgttcgtccgttggtttacaaaacggaaaagggggacgacggaccctaaggtcctcgtctctcgtagaaccagacgtaggaagtacgacgtcccgtctaggttcagtcgccacgtcgaggtcgggtcgggacccggacgtcccaacttcctacgaaccgtagttacggcccgtaccgttcggacccgggtaccgtaggtaacggtactttaccgttacgtaaccttaaacgttttacgtttccgttaggtaccgtaacgtcgttaacgttactaccgtaagtttaccggttacccggttacccccgtttacgttaccggtttttaccgggacccggtaaccggggtaaccgtaacggtaccggttaacgggtaaactaacccggtaaaacgtaacgttccgggtacggtaccgtaccggtaccgtaacccgttacgttaccgttaccgtttacctttaccgtaccttccccgttaccccggtcctaacgtttaccg

SEQ ID NO: 71517 - DNA, 711 bp, Homo sapiens
  misc_feature: GYAE6OF01BXNX4.44.59.F04.1.454.CMB.1.raw
  modified_base (255)..(255): a, c, t, g, unknown or other
  misc_feature (255)..(255): n is a, c, g, or t
  modified_base (671)..(671): a, c, t, g, unknown or other
  misc_feature (671)..(671): n is a, c, g, or t
  modified_base (678)..(678): a, c, t, g, unknown or other
  misc_feature (678)..(678): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtcctccttccttcctgtcttcttctgttggagcagctcaccatcacgttcggccgggcgagtcgtagggtttccggttttcggngtcgttggttcgtcccgtttagggtttaccaaaaacgggaaaaagggggcgaccggtaccccgttaaggtccctccgtctccgtacggtacgaaacccaggtacgtagggaacggtagaccggttccccgtacgtaggttcgaggttcgccgtagtccgagggttcgggtcggggccggtacgtcccacgttcctaccgtacgtagttacggccgtaccgtggacccgtctaggtaactacttcgtcgtaaccttaacttttacgtttcgtcgtacgagtacgtaagttactacgtaacgttacgtccgttccccgtttacgttaccggttttccgggaccgtaacgggggtaacctaacggtcgttaacggaaactaccgaaaacggtacgttggaccgtcgtcgtacctacgtnttccgtntttcctctaccttccccgttcccacgtcttacg

SEQ ID NO: 71518 - DNA, 696 bp, Homo sapiens
  misc_feature: GYAE6OF01A8W7Z.44.59.F04.1.454.CMB.1.raw
tcagacagtatatacacgaccggtgctcgatttagtacacacacttagggattggggagcttcagctgtggtagagaagacaggattcaggacgatctccagcatggccagcttccctctcctcctcaccctcctcactcactgtgcagggtcctgggtccagtctgtgatgtctcagccaccctcagcgtctcgggacccccgggcagggggtcaccatctcttgttctggaagaagtccaatatcggatcttatcctgtacaactggtagtcggggactccgaggccaccggccccccgactccttatctatcgctactaatcacgccgccctcgacgggtccctcgcccgtattctcgtcggcctccgaagtcgtcggacaactacgacggtcctacccgtcggaccctacttcccgttagtacctccgttacccgtacgttacgtaggtaacggtagttcggaacgggtccttaggtaaccttttaaccgtacgttggtacgaccgtaagtccgtaaggtaggggtaactacggaaccgacgggacccgggtaacggtcgggttaggggttcgggttaccgggaacgggggtaaccggtaaccggtaagggttaccggtacccggttacccgtagggtacccgaaccggtaccccggtaaagggtccccgttacccggtccccccggtacgg

SEQ ID NO: 71519 - DNA, 550 bp, Homo sapiens
  misc_feature: GYAE6OF01AOETJ.44.59.F04.1.454.CMB.1.raw
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
  modified_base (322)..(322): a, c, t, g, unknown or other
  misc_feature (322)..(322): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (418)..(418): a, c, t, g, unknown or other
  misc_feature (418)..(418): n is a, c, g, or t
  modified_base (453)..(453): a, c, t, g, unknown or other
  misc_feature (453)..(453): n is a, c, g, or t
  modified_base (547)..(547): a, c, t, g, unknown or other
  misc_feature (547)..(547): n is a, c, g, or t
tcagacagtatatacacgaccggtgctcgatttagtacacacacttagggattgggggcatgagtcagaccctgtcaggggacagcatggacatgagggtcccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgccttggtttcaacgaaaagggggnacggccctaaggtcctcgtctctcgtgaaccngactggaggtagngtcccgtcaggttcagtgccagtccaggtggtgggccggagtccactctcacctattacgccgacctggccggcctgaagnttcncgactaacttntttctgtcagcagtatcattacgtcgtccccgttntaccgttttcggccgtaggggaccaaggtctaggaaactacgaaacgtacgtggtagcgtcgaccactctctgtccttcattccctcccgcctntcg

SEQ ID NO: 71520 - DNA, 798 bp, Homo sapiens
  misc_feature: GYAE6OF01CKJVZ.44.59.F04.1.454.CMB.1.raw
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
tcagacagtatatacacgaccggtgctcgatttagtacacacacttagggattgggggcatgagtcagaccctgtcaggggacagcatggacatgacgggtccccgctcagctccgtggggctcctgctgctctggctcccaggttcgagatgtgacatcgagatcgacccatcctccttccttctgtcttcttctgttggagcagcgtcaccatcacgttcggccgggngtaacgtcgtacggttccggtttttcggngtcgttggtttcgtcccgttagggtttaaccgaaaaacggtaaaaaacggggggtcgaaccgggtaccccgttaaacgggttcccttcggttaccgttccgttaccggtaacgaaaaccctaggaaccgttaagggaaaccggtttaacggaccgttcccccggtacgtaacgggtttcaaggttccggaaccgtacggttaccgaaggggttcggggtacgggggacccggtaacggtccctaaacgttccgtaccgaaaccgttaacgttaccggacccgtaacggtcggccgggacccttaggaaaggttacttcgtcggtaacttaaacgttttcgtttacacggttacagtaccgtaagtactacgagtttaacggccgttaccccgtttagttaccggtttacggacccgttaaaggggaaccctaaggtaacgtaacgtaaacgtaaccgtaaacgtacgtcggtagaccgtacgacccgactacttcggttacttacttactaacgtttcccgtccccgtataacgttacg

SEQ ID NO: 71521 - DNA, 700 bp, Homo sapiens
  misc_feature: GYAE6OF01CV3GM.44.59.F04.1.454.CMB.1.raw
  modified_base (256)..(256): a, c, t, g, unknown or other
  misc_feature (256)..(256): n is a, c, g, or t
  modified_base (325)..(325): a, c, t, g, unknown or other
  misc_feature (325)..(325): n is a, c, g, or t
tcagacagtatatacacgaccggtgctcgatttagtacacacacttagggagttgggggcatgagtcagaccctgtcaggggacagcatggacatgagggtccccgctcagctcctggggctcctgctgctctggctcccaggttcgagatgtgacatcgagatcgaccctagtcctccttccttcctgtcttcttctgttggagcagcgtcaccatcgacttggccgggcgtacgtcgtacggttcgttttcggngcttgttcgccttaggttacaaacggaaaagggggcacggccctaaggtcctcgtctctcgtagaaccngacgtaggaagtacgacgtcccgtacgtaggttcagtcgccgtaggtaccgagggttcggtcggggtacccgacgttccacgttcctaccgaccgtacgttacgacccgtaccgttcgggaccggtcctaaggaacgtctttccgtacgtaccttaacttttctttaccgtagttaccagtactaagttactcgtaagttacgtcccgtaccccgttttacgtaccgttttcgggacccggtaacggggtacctaaggtacttaacgggaactaccggaaaacgttacgtggtacggtaccgtccgtaccgtaaccttagttcccgttagtttcctttaccgaccgtttcccgtttacccccgcttacgttaccg

SEQ ID NO: 71522 - DNA, 631 bp, Homo sapiens
  misc_feature: GYAE6OF01CMHT1.44.59.F04.1.454.CMB.1.raw
  modified_base (224)..(224): a, c, t, g, unknown or other
  misc_feature (224)..(224): n is a, c, g, or t
  modified_base (389)..(389): a, c, t, g, unknown or other
  misc_feature (389)..(389): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagacagtatatacacgaccggtgctcgatttagtacacacacttagggattgggggcatgagtcagaccctgtcaggggacagcatggacatgagggtccccgctcagctcccggggctcctgctgctctggctcccaggttcgagatgtgacatcgagatgacccagtctccttcctctgtcttcttctgttggagcagcgtcaccatcacgttgccgggnagtcgaggttcgtttcggtgcttgtcgccttaggttacgaaacgaaaaagggggagacggacccgtaagtcctcgtctcgtacgtacgaaaccagacgtaggaagtagacgtcccgtacgtagtacgagtcgaccagtcgaggtggtcgggcggacgtccactcncgactagttacgcgacctgccgactgaatctacgtctactaactttnttcgtacgtacngactaagtctacgattacgtcccgtacccgttattacggtttcgaccggaacggtaaaccctaataaacgggtaaacttaacggaaaacgttcgttaggtacgactacggaccctaactacgttcctcggttaccttacgtacctttaccccgttaccccgactaacgtttccgtagttaaac

SEQ ID NO: 71523 - DNA, 1030 bp, Homo sapiens
  misc_feature: GYAE6OF01ENKRS.44.59.F04.1.454.CMB.1.raw
tcagacagtatatacacgaccggtgctcgatttagtacacacacttagggattggggagcttcagctgtggtagagaagacaggattcaggacaatctccagcatggccggcttccctctcctcctcaccctcctcactcactgtgcagggtcctgggcccagtctgtgctgactcagccatcctcagcgtcgtcggggacccccgggcaggaccggtcacgtatttcgttttgttctagggtaaacgttacggtacccaaacgtagttaccgggaaaagtttaaacgttttaaccggttaattaaccgttagggtttaaacgtccggggtaacctaaacttttaccgaaaccggtaaggggtaaaccggtcccccgggggttacccccccctaaaccggtaaccccccccccttaccgtaaacgtttacccgttaaaggttaaacgggggggtaaacgtaaaacggtacccggtaacgggtcccccgggtacccccgtaccgggtaaccggggggtttcccccccgtacgggtaaaccccggttaacgttttcccttaccggttacccggtacccccgttacccccggtaaaaggtttccccgttacggggtaccccctaaccccgttccccgtaacccggtcccccctttaccccccggtccgggtaccccttaaccgtacccgggttaacgggttcccggggggtccccgtttacccccgggggtacccggggtaaacgggtacggttacgggtaaccggggttcccgttttaagggtttaacttttttaaccgttttcggttcggggtttcggggcccgggtttcggggtttaggggtaacgttacggtaaccgttacttacccgggttagggtacgggttcgggaaccgttggttaaccgttacgggttccggggacggggtaaccgggaaccggtaacgggtcccttaccgggtacccgttaccgttaacggtacccgaaccggaaccccgtaaggtcccgtccccggtcccccgttacccggg

SEQ ID NO: 71524 - DNA, 659 bp, Homo sapiens
  misc_feature: GYAE6OF01D5RK0.44.59.F04.1.454.CMB.1.raw
  modified_base (247)..(247): a, c, t, g, unknown or other
  misc_feature (247)..(247): n is a, c, g, or t
  modified_base (280)..(280): a, c, t, g, unknown or other
  misc_feature (280)..(280): n is a, c, g, or t
  modified_base (467)..(467): a, c, t, g, unknown or other
  misc_feature (467)..(467): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctggttggaggcagcgtcaccatcacgttgccggcgagtcaggttcgttttcggngctgtcgccgttggttacaaacgaaaagggggngacggccctaaggtcctcgtctctcgtagaaaccagtacgtagggaagtagacgtcccgtcgtaggttcagtggcctagtccgaggtggtcggggccgagtccactctcaacctagttacggccgtaccgtgccgggacctaggaacgtacttcgtagtactaactttatttctagtcagctagtanctagtacgtccgtcccgttcgtaccgttttcgggaccgtaacggggtaccctaaggtcgtaacgggtaaactaccgaaaaccggttaacgttcggtacggtaccgttcggaacctacccgtaagtttcccgttacggtttaccctttacccgttacgtttccccgtttacccccgtccgtaagtttacccgg

SEQ ID NO: 71525 - DNA, 675 bp, Homo sapiens
  misc_feature: GYAE6OF01C5MZQ.44.59.F04.1.454.CMB.1.raw
  modified_base (108)..(108): a, c, t, g, unknown or other
  misc_feature (108)..(108): n is a, c, g, or t
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (353)..(353): a, c, t, g, unknown or other
  misc_feature (353)..(353): n is a, c, g, or t
tcagacagtatatacacgaccggtgctcgatttagtacacacacttagggagttgggggcatgagtcagaccctgtcgagggacagcatggacatgacgggtccccgntcagctcctgggctcctgctgctcgtggcctccgaggttcgagatgtgacatcgagactgacccagtcctcctccttctgttcttcttcgtgttggaggcagcgtcaccatcacgtgccggcagtcgaggttcgtttgngtctgtcgtaccttggttaacaaacggaaaaggggtcaaccggacccgtaaggtcctcgtcgtctacgtacaaaacgngaccgtggaaacgtgacgtcccgtacgnggttacaggccgtcgacgtccggtaagggtcgggtccgggaccggtctaccgtacctcgtacgaccttagtaccgccgtacgttcggacggtacctggaaactcgttaacctgtaacctaagtttcttcgtatacgacgtactaagtactacgtacgttaacgtccggttaccccgtttagtacccgttttacggaccgtaacggggtacctaagggtaccttaacggaacgttaaccgaaacggtacggtcggtaaccgtcgtacgacccacgttacgttctcgttacgttccgaaccgttccctaccgcgttagttaccg

SEQ ID NO: 71526 - DNA, 797 bp, Homo sapiens
  misc_feature: GYAE6OF01DTCOG.44.59.F04.1.454.CMB.1.raw
  modified_base (240)..(240): a, c, t, g, unknown or other
  misc_feature (240)..(240): n is a, c, g, or t
tcagacagtatatacacgaccggtgctcgatttagtacacacacttagggattgggggcatgagtcagaccctgtcaggggacagcatggacatgagggtcccccgctcagctcctgggctcctgctgctctggcctcccaggttcgagtatgtgacatcgagatcgacccagttcctccctttccttcctgttcctttcttcgtgttggaggcagcgtcaccatcacgttcggccgggngagtcgtaggttcggttttcggtgtcttcgttcgtccgttaggtttaacaaaacgggaaaaacgggggtacgaaccggtaccccgttaaggtccctaccgtccttacgtacggtaacgaaacccgaggtaaccgtagggtaacggtacgtaccggttccccgtacgttacggttacgacggtcgaccgtaacggttccgtaaggggttgggtaccggggacccggtaccgtccctaccgttccctaccgtaacctacgttaccgggccgtaccggtcggcccggtacgttacggaacgttctttaccgtagtaaccctttaagttttactttccgtgttaccgagtacgttaacgttactacgtaagttccggttacccgttaccccgttttagttaccggttttacgggaccgtacggggtaacctaaggtacgttaaacggtaacctaaccggtaaacgttacgtggtaccgtacgttaccgaacccttacgttcgttaccgtttccgttaccgttaccgtacccttttcccccgtacccgtacttaccgttacg

SEQ ID NO: 71527 - DNA, 884 bp, Homo sapiens
  misc_feature: GYAE6OF01CZS3K.44.59.F04.1.454.CMB.1.raw
  modified_base (259)..(259): a, c, t, g, unknown or other
  misc_feature (259)..(259): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtctcccttccttccttgtccttcttctggttggagcagcgtcacctatctacgttcggccgggcgtagtcgtaggttccgttttcggngcgttgttcgccgttaggtttaacgaaaacggaaaaaggggggacgaccggtacccccgttaaggttcccctcggttcctacggttaccggtaacgaaaacccgtggtaaccggtagggaaacgggttacggtaaccggttcccccggttaccgtaacgggtttaccacggttacggacccgtaggtacccggtaaggggttcggggttaccgggggtacccgggtaacgttaccccgtaaccgttccgtaacctaacccgtagtttaaccgggacccgttaaccgtccggggacccgggtaccgttaacggtaaaccgttacgtttaccgttacggtaaaccttaaaccgtttttacgttttaccgtacggttaccgtaggtacctaaacggttactacgttaacgttaaccggttccccggttacccccgttttacgtttaacccggtttttacggggaaccccggtaacgggggtaaaccctaacgggttaacccgttaacggggtaaaccttaaccggtaaaaaccgttacggttccggtacggtaccgttaccgaccgttaacctacgttccgttacgttccttacggtaccctttcccgttcccccgattacgttaccg

SEQ ID NO: 71528 - DNA, 736 bp, Homo sapiens
  misc_feature: GYAE6OF01BGM1O.44.59.F04.1.454.CMB.1.raw
  modified_base (252)..(252): a, c, t, g, unknown or other
  misc_feature (252)..(252): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtcctccttccttcctgtcttcttctgttggacgcagcgtcaccatcacgttggccgggcgagtcgaggtttcgttttcggngtcttgttgccgttggtttacaaaacggaaaaggggcgacggtcccgttaaggtccctcgtcctcgtacggtacgaaaccgagacgtagggaaggtacgacggtccccgtacgtaggttcgaaggtccgaccgtacggtaccggagggttcggggtacggggaccggtacgttccctacgtccgtaccgaccgtacgttacggccgtaccgtcggccggtaccgtaggaacttcttccgtacgtaccttaaacgtttactttcgtacggtacaacgtacgttaacggttactaccgtaacgttacggttccccttaccccgggtttcttaaccggttttcgggaccccggtaacggggtacctaaggtccgtaaacggtaaacctaaccggtaaaacgtacggttcggtacggtaccgtcgtaccctaacgttattccgtacgtttacctctacccgtttacccgttaccccgtatcgttaccg

SEQ ID NO: 71529 - DNA, 659 bp, Homo sapiens
  misc_feature: GYAE6OF01DVQVS.44.59.F04.1.454.CMB.1.raw
  modified_base (246)..(246): a, c, t, g, unknown or other
  misc_feature (246)..(246): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcgtgttgccttggtttacaaacggaaaagggggagacggaccctaaggtcctacgtcctctacgtacgaaaccagacgtggaaggtgacgtcccgtcgtaggttacagtcgcctaggtccgaggtcggtcgggaccggtacgtccgactctacacctagtacgcgtaccgtggccggtacgtagaacgtacgttccgtcggtaccttaacgtttactttcgttacgtacgtacgtacgtaacgttatacgtacgtacggttccggttaccccgtttcgttaccgttttaccgggaccggtaacggggtaccgtacgtaccgtaaggtaacgtacgaaaccgtacgtgtcggtcgtacgacctaccgtactccgttcttacgttccgtacttcccgttaccctcgtcttaccg

SEQ ID NO: 71530 - DNA, 742 bp, Homo sapiens
  misc_feature: GYAE6OF01EUEKX.44.59.F04.1.454.CMB.1.raw
  modified_base (170)..(170): a, c, t, g, unknown or other
  misc_feature (170)..(170): n is a, c, g, or t
  modified_base (251)..(251): a, c, t, g, unknown or other
  misc_feature (251)..(251): n is a, c, g, or t
  modified_base (735)..(735): a, c, t, g, unknown or other
  misc_feature (735)..(735): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccgaggttcgagatgtgacatcgagatgacccngtctccttccttctgtcttcttctgttggagcagcgtcacatctacgttcggccggcgagtcgtacggtttcgttttcggngtcttggttcgtccgtttagggttaccgaaaaacggtaaaaaggggggcgtaccggtacccgttaagggttcccttcggttcctccgttacgaacgaaaccgtaggtaccgtagggtaaacggtacgaccggtcccgtacgtacgggttcagtcgccgtacgtccggtagggtcggggtacggccggtaacgtcctactcctacgtaaccgtagttcggccgtaccgtcggaccggttctaggtaacgtacgtttcctacggtacctttaaacgtttcttttaccgtacgtacgtagtaccgtaaggtttactactaggttacggtcccgtttccccgtttacgttacggttttccgggaaccgggacgggtaaccgtaacgttcgtaacgtaaaactacgtaaacgttaccgtagggtacgtccgtacgacctaccgtattcccgtttagtacccttaccgttacttccccttacccgcgttnttaccgg

SEQ ID NO: 71531 - DNA, 717 bp, Homo sapiens
  misc_feature: GYAE6OF01DKJ2E.44.59.F04.1.454.CMB.1.raw
  modified_base (252)..(252): a, c, t, g, unknown or other
  misc_feature (252)..(252): n is a, c, g, or t
  modified_base (635)..(635): a, c, t, g, unknown or other
  misc_feature (635)..(635): n is a, c, g, or t
tcagacagtatatacacgaccggtgctcgatttagtacacacacttagggattgggggcatgagtcagaccctgtcaggggacagcatggacatgagggtcccccgctcagctcccggggctcctgctgctctggctcccaggttcgagatgtgacatcgagatcgaccagtcctccttccttctgtcttcttctgttggagctagcgtcacctatctacgtggccgggtcgagtcgtaggttcgtttcggngtctgttcgtccgttggtttacaaacggtaaaaggggcgacggtaccctaaggtcctcgtactcgtacgtacgaacgacgacgtaggaagtgtacgtcccgtacgtagtcaggtcgccgtacgtccggtagggtcggtcgggaccggtacgtccctaccgtcgtacccgaaccgtagttaccgccgtaaccggtcggacccggtaccgtaaggaacgttcgtttaccgtcgtaaccttaaacttttacgtttcgtacgtacgaacgtacgtaagttacctagtacgttacgggttccccgtacccgtttacgttaaccggtttcggaacccggttacgggtaaccctaaggtaccgttaaggtaaacctaaccgaaaccggtntacgggacgtccgtaaccgtctaccacttcgtaccgttaccttacgttacttaccccgtaccggtcttaacgtccgttaacg

SEQ ID NO: 71532 - DNA, 830 bp, Homo sapiens
  misc_feature: GYAE6OF01CILZV.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagttctcccttccttcctgtctttcttctgttggagcagcgtcaccatcacgttcggccgggcgtagtcgtaggttccggttttcggtgtcttggttcggcccgtttagggtttaccaaaacgggaaaaaggggggcgaccggtaccccgtaagggttcccttcggtccttccgtacggtacgaaaacccgtggtaaccgtaggggaaagtacggaccggttccccgtcgtagggttaccgagtcgacccgtacggttcccggaggggtttcggggccggggtacccggacgttccccacgttcctaccgtaacctaagtttcccggacggtacccgttcggccggttacccgtaggtaacgttactttccggtacgtaaccctttaaaccttttagttttcgtacggttaccaacgtaccgttaagttacgttacgttaaccgttacgggttcccgttaccccccgggttttatttaacccgggtttttaccggggacccgggtaaaccgggggtaccctaaacgggtcccggttaaacggtaaacctaacccggtaaaaccggtacgttcggaccgggttaccctaggaccctaaccgttctttcccgttacgtttccctttacgtaccgtttccccctccccggaccttgttacccgg

SEQ ID NO: 71533 - DNA, 642 bp, Homo sapiens
  misc_feature: GYAE6OF01BOQ3K.44.59.F04.1.454.CMB.1.raw
  modified_base (246)..(246): a, c, t, g, unknown or other
  misc_feature (246)..(246): n is a, c, g, or t
  modified_base (277)..(277): a, c, t, g, unknown or other
  misc_feature (277)..(277): n is a, c, g, or t
  modified_base (311)..(311): a, c, t, g, unknown or other
  misc_feature (311)..(311): n is a, c, g, or t
  modified_base (443)..(443): a, c, t, g, unknown or other
  misc_feature (443)..(443): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgtcgggcgagtcaggttcgttttcggngctgttgcctggtttacaacgaaaagggggnacggccctaaggtcctcgtctctcgtagaaaccngacgtggaaggtagacgtcccgtcaggttcagtgccagtccgaggtggtcgggccggagtcccacgtcgtcacctagttacgccgtacctggccggtcctaggaacgtctttccgtagtaccttaaactttntttcgtagtacgtagtctagtatctacgtacggtccgtccccgtttcgtaccggttttcggacccggtaacggggtaaccctaaggtccgttaaggaaactaccgaaaacggtacgttggtacggtacgtcgaccgtaaccgtcttccgttacgttccttacctaccgttcccgttacccccgtacgttacgttaccgg

SEQ ID NO: 71534 - DNA, 714 bp, Homo sapiens
  misc_feature: GYAE6OF01B9VTV.44.59.F04.1.454.CMB.1.raw
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
  modified_base (315)..(315): a, c, t, g, unknown or other
  misc_feature (315)..(315): n is a, c, g, or t
tcagacagtatatacacgaccggtgctcgatttagtacacacacttagggattgggggcatgagtcagaccctgtcaggggacagcatggacatgagggtccccgctcagctcctgggctcctgctgctctggctcccaggttcgagatgtgacatcgagatgacccagtctccttccttcctgtcttcttctgttggagcagcgtcaccatcacttgccgggcagtctagggttcgttttcggngcttgttgccgttggtttacaaacggaaaaggggnacggccctaaggtcctcgtctctcgtacgaaaccngacgtagggaaggtagacggttccccgtactacgggtttacacggtcgcccgtagtcccgagggtcgggtcggggacccggtacgtccctactctaccctaactagtttaacgccgtaacccttgggacccggtccgtaaggtaacgtacttcgtacgtaccttaaacttttacgtttctacgttaccgagtctaacgttactactacgttacggtccgttccccgtttacttaccgttttacgggacccggtaacggggtacctaacggtccgtaacggtaacgtaaccgaaacggtaaccggtgttacgggtaccgtacggaccctaaccgtaactttcgttaccgtttactttaccgtaccgtttaccccgttaccccgtcctaccgtttacccgg

SEQ ID NO: 71535 - DNA, 828 bp, Homo sapiens
  misc_feature: GYAE6OF01BEHCJ.44.59.F04.1.454.CMB.1.raw
  modified_base (212)..(212): a, c, t, g, unknown or other
  misc_feature (212)..(212): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccntcacttgccgggcgagtctagggttcgttttcggtgtcttggttcgtccgttgggttttaccgaaaacggaaaaaggggggagaccgggaccccgtaaggttcccgtcgttcctcgtaccgtacgaaaccgaggacgtagggaacggtagacggtcccgtcgtaggttcaggtcgccgacggtccgagggttcggggtcggggtcccggacgtacccgtacgtcctaccgaccgtattacggccgtaccgttcgggaccggtacccgtaggaacgttacgtttcgtacggtaccctttaaacgtttaacttttccgtacggttaccaacgggtacctaaacgggttacttaccgtaacggtttacggttcccggttaccccccggttttacgttaacccggtttttccggggaaccccgggtacggggggtaaaccccgttaaacggtcccggttaaacgggtaaaaccggttaacccgtaaaaaacccgggtacgttacggggttaccgggtaacccggttcgggtaacccctaacccggttcgttaacccgttcccgtttacccgtttaccgtaccctttccccgttacccccggttccgtacgtttaacccgg

SEQ ID NO: 71536 - DNA, 709 bp, Homo sapiens
  misc_feature: GYAE6OF01DLS5W.44.59.F04.1.454.CMB.1.raw
  modified_base (246)..(246): a, c, t, g, unknown or other
  misc_feature (246)..(246): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
tcagacagtatatacacgaccggtgctcgatttagtacacacacttagggattgggggcatgagtcagaccctgtcaggggacagcatggacatgagggtcccccgctcagctcctggggctcctgctgctctggctcccaggttcgagatgtgacatcgagatgacccagtctccttccttcctgtcttcttctgttggaggcagcgtcacatcacttgccggcgagtctaggttcgttttcggngcttgttcgccgttggtttacaaaacggtaaaaaggggggcgaccctaaggtcctcgtctcgtcgtagaaaccngacgtggaagtagacgtcccgtacgagttcagtnccagtcaggtggtggccgtagccatctcactatacgccgtactcgccggtctaagagtacttcgtacgtacttaaacgtttactttacgtaagttccgaacgttaccgtaaggttaacttacgtaaacgtttaccggtccggtttaccccccgttttacgtttaacccggttttttacgggaccccggttaaacggggggtaaacccccgtaaaggtacccggttaaacgggtaaaaccttaccggaaaaaaccggtaacgtttacgggtacggtactacggtaccctaaacccttacgtccgtttacgtcctttaccgacttttacccctaccccggtacctcgttcgttaacg

SEQ ID NO: 71537 - DNA, 729 bp, Homo sapiens
  misc_feature: GYAE6OF01ED2IQ.44.59.F04.1.454.CMB.1.raw
  modified_base (147)..(147): a, c, t, g, unknown or other
  misc_feature (147)..(147): n is a, c, g, or t
  modified_base (583)..(583): a, c, t, g, unknown or other
  misc_feature (583)..(583): n is a, c, g, or t
tcagacagtatatacacgaccggtgctcgatttagtacacacacttagggattggggagcttcagctgtggtagagaagacaggattcaggacaatctccagcatggccggcttccctctcctcctccaccctcctcactcactgtncagggtcctgggcccagtctgtgctgactcagccatcctcagcgtcgtcggggacccccggcaggcgtacacgtattcgttttgttcgtaggaagtacggtccaactagtcggaaagttattaacgtatactggtatcggtactaattcaacgaggacgcccggtaccccacgacccctcgatacgtacgagggagaactcggacgacccggtccgtacgacggggttcccctacggaccgttagttccgtcgtacgtccccttacgaacggttcgtaccggtaccacccgttacgacccggtcccttcccgtaccgggtcctaacgtccgtaacgggtccggggttacccggtcccgggtaccggtaacgggacgtacgggtacggtacgtttacgtactttaacgtttcgttggtcggtacgggtcgttaggtntaggtacctacgttcgtagtaggtacggtcgtacggtccttacggtccgggacggggtaaccgaccgtaaggtccttacggtaacccggtcgttaaacggtccgaaccggtacccgaaccggcgttaccccggccccgttacccgg

SEQ ID NO: 71538 - DNA, 895 bp, Homo sapiens
  misc_feature: GYAE6OF01CWL7U.44.59.F04.1.454.CMB.1.raw
tcagacagtatatacacgaccggtgctcgatttagtacacacacttagggattgggggcatgagtcagacccagtcaggacacagcatggacatgagggtccccgctcagctcctggggctcctgctgctctggctcccaggtgccaaatgtgacatccagatcgacccagtcctcccttccaccctgtctgctatcgtggtagagacagtacgtaccaacctactccgtacgttcggacccggggacctaacggtcgaaggtaaggtttaagtttaggttagggttttcgggttcggtacccgttgggttaactacgacggaacaaaacggaaaaccgaacggggtaaacccgtaaccccccgtaaaccgttaccgtacgtaactttaccgtaaaggttaaaccggtactaacgtttacggttttaacgggttttaacgggaaaccggggttccggggtaacccctaaggttaaccggtaacggtttaccgaacgggtccgggtaccgttacggggtttacggggttaccgggtacggggtaaaccgtacgggtttaaccgtttacccgtactttaacccgtacccgtacctaacgttccggacgtaccgacggtacccgtacgaccgtacgtaccgttagttacgttagtttacgtttaccgtaaaccttttaacctttaacgttacctaacggtaccttaaaagtacggtttaaaagtttacgttaacgtttaacgtttaccgtaacgggtttaggtttaaccgggttaccggaacccggggtaaacgggttaacctaacggggtacggtacggtaacgtaaaaccgtaaaccggtaaacgggttacgttacggtaccggtaccgttaacccgtaccgttccgttaacccgg

SEQ ID NO: 71539 - DNA, 914 bp, Homo sapiens
  misc_feature: GYAE6OF01EG70E.44.59.F04.1.454.CMB.1.raw
  modified_base (252)..(252): a, c, t, g, unknown or other
  misc_feature (252)..(252): n is a, c, g, or t
  modified_base (277)..(277): a, c, t, g, unknown or other
  misc_feature (277)..(277): n is a, c, g, or t
  modified_base (708)..(708): a, c, t, g, unknown or other
  misc_feature (708)..(708): n is a, c, g, or t
  modified_base (900)..(900): a, c, t, g, unknown or other
  misc_feature (900)..(900): n is a, c, g, or t
tcagacagtatatacacgaccggtgctcgatttagtacacacacttagggattgggggcatgagtcagaccctgtcaggggacagcatggacatgagggtccccgctcagctccgtggggctcctgctgatctggcctccgaggttcgagatgtagactagtcgagtagtacgacccgtagttccttcccttccttcctgttctttcttcgtgtggacggcagtcgtacacctactcgtacgttcggccggngtacgtcgtaggttccggttttggngtcgtttggttcgtccgttaggttaccaaaagggaaagggggtcgaccggtaccccgtaaggttccctcggttaccttacgtaccggtaacggtaacccgtaggtacggtaggggtaaacgtacggtccggttccccgtacgtagggtttacacggttacgacccggtacgggtaccggtaggggttgggggacccgggtaccggggtactacccgtaccggttacctacccgaactttacggttacccggccccggttaacgttaccggggcccggttaaccgttaggtaaaaggtttcccttacggttaacgtaccctttttaaaacgttttgtacccggtttaacggttacccgaagttaccggttaactttaccgttaacccgttaagggtttaccccgggtttcccctttaaccccccgggttttnttttaaccccggggttttaacggaaccccggggtacccggggtaaaatacgggttttcccgaaacgggttaaaactaccgggttaaaaccggtacgtttgaaccggggttacccaccggtacgttaaaccccgttattttcccgggtaaacttttccccttaaacgttccgttacccccccgggttaacctnttaccgtttaacgg

SEQ ID NO: 71540 - DNA, 772 bp, Homo sapiens
  misc_feature: GYAE6OF01D4JHR.44.59.F04.1.454.CMB.1.raw
  modified_base (760)..(760): a, c, t, g, unknown or other
  misc_feature (760)..(760): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtcctccttccttcctgttcttcttcgtgttggaggtcagccgtcgacctatcctacgttcggccgggcgtacgtcgtacgggttccggtttttcgggtcgtcgttcggttcgtccgtttaggtttaccaaaaacgggtaaaaaggggggccgaaccgggtacccccgttaaagggttcccttcggtacctccgtacgtacgaaaacccaggtaccgtagggaaacggttacgaccggtccccgttacgaggttccaaggttgtaccgtacggtccggtaggggtcgggtacgggccggtacgttccgacgttcctaccgaaccttacgttaccggccgttacccggtcgggtcccggtaccgtaggtaaaacggttccttcgtaccggtaacctttaacgttttcgtttccttacgggtactacggtactacgttacttacgtaagtttaccggtccgttaccccgtttcgtttaaccggtttcgggaccgtaacgggtaccaaggtccgtaaggtaaactaccggaaacgtacggtcgcggtacctagaccctacgtctcgttctccgtctaccttccctacccggattacgntttacgattacg

SEQ ID NO: 71541 - DNA, 814 bp, Homo sapiens
  misc_feature: GYAE6OF01D23ZX.44.59.F04.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
tcagacagtatatacacgaccggtgctcgatttagtacacacacttagggagttggggcatgagtcagacctgtcagggacagcatggacatgaggtcccgctcagctcctgggctcctgctgctctggctccaggttcgagatgtgacatcgagatgacccagtctccttccttcctgtcttcttctgttggagcagcgtcaccatcacttgccgggngagtcaggtcgttttcggngtcttgttcgtccttggtttacaaacgtaaaaagggggcgaacggacccctaagggtacccttcggtccttaccgtcggtacgaaaccgtgaacgtgggtaacggtagacgtcccgtccaaggtttccaggttacgccgtaaggtcccgaaggtcggtacggggccggtacgtcccgtacgttcctcaaccctagtttaacgccgtaaccttcggacccgtccgtaggaaacgtacttccgtagtaccgtaaactttacgtttaccgtacgttaccgtaacggtaccgttaacgttacgttacccgtacggtttaacggtacccggttaccccgttttaacccgttaaaccgttttttcccgggggaccccgtaaaccgggggggtaccccttaaagggttcccggttaaacgggttaaaaccgttaccccgttaaaaaccgggtaacccgtttacgggttaccggttacccggtaccggtacccgtaacccttacggtttacccgttacggttaccccttttaccggtaaacccttttccccggtttaaccccccgtcgttaacccggttacccg

SEQ ID NO: 71542 - DNA, 736 bp, Homo sapiens
  misc_feature: GYAE6OF01B021G.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctgggctcctgctgctctggctccctaggttcgagatgtgacagtcgagatgacccagttccttccctttccttcctgttcctttcttcgttgggttgggacggtcgacgccgtccacctattccgacgttcggccgggacgtagtccgtaggtttccggttttcggtgtcttggttcgtccgttaggttacaaaaggtaaaggggacgaccggtaccgtaacggtccgttcgtcctcgtcgtacgaaccgacgtacgtaggtaaggtacgtacgtcccgtacgtacggttcgagtcgaccgtacgtccgtaggtcggtcgggaccggtcgtacccgtacgtcctaccgacctagtacgcccgtacgtcggacggtctaacggtacgtacttacgtcgtacttaacgtttccgtttcgtacgtaccgacgtactacgttactatacgtttccgtcccggttaccccgtttaggttcccggtttaccggtacccgggtaaccgggtaaccggtaacggtacggtaacggtaaacgtaccggaaaacgttacgacggttgacgtccgaacctaccgtcgttacttacgttactttccgtacccgttccttccctaccttgtaccg

SEQ ID NO: 71543 - DNA, 752 bp, Homo sapiens
  misc_feature: GYAE6OF01CYPO8.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctgttccccggtgccaggtgtgacatcgagatcgacccagtctccgtcctcactgtctgcgtctagttgggacagacgtcacctatcacgttggccggacgagtcgccgtactagtttagggttacttttttcgggccttgggtttacaggtcgtaacgggacgtcccgtaggaccaaaaccggtcccccttaacggtccctagtactttccgttttacgacggtacttccctacgttttaggaaggtacggtacggtacgtcccgagtccgtaggtcgacggcggtcgtaggttcggtcgtagggtactacgtactttccgacttcactacctatcgagtccgtacgcctggacctacggtacctagggtacgtacgtttccgacgttactttacttacgtcgtaaccctaagttaactttacttttaccgtttttaacgtacccggtttacgtttacggttttaccgggaccggttaaaccggggtacctacgggttaccgtaacgggtaaacggttaaacgtaaaccgggtaaagggttaccgttagggtacggtacttaccggtaccctaccgttaacgtttccgttacgtttccgttacccgttaaccgttaccccg

SEQ ID NO: 71544 - DNA, 739 bp, Homo sapiens
  misc_feature: GYAE6OF01C7QGQ.44.59.F04.1.454.CMB.1.raw
  modified_base (107)..(107): a, c, t, g, unknown or other
  misc_feature (107)..(107): n is a, c, g, or t
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (329)..(329): a, c, t, g, unknown or other
  misc_feature (329)..(329): n is a, c, g, or t
tcagacagtatatacacgaccggtgctcgatttagtacacacacttagggattgggggcatgagtcagaccctgtcaggggacagcatggacatgagggtcccccgntcagctcctggggctcctgctgctctggctcccaggttcgagatgtgacatcgagatgaccagtcctccttccttcctgtcttcgttctagttggagcagccgtcacatcacgttgccgggnagtcgtaggttcgttttcggngtcttgttcgccgttaggttacaaaacggtaaaaggggcgaccggaccctaggtccctcgtctcgtacggacaaaccgngacgtaggaagtacgtaccgtcccgtacgtaggtcagtcgccgtagtccgaggtcgggtcgggacccggtaacgtccctactccgtacctaaccgtaagtttccggaccgtaccgtcgggacccgtaccgtagtaaagtctttaccgtagtaaccgtttaaacttttcgttacgtacggtacaacgtacgttaacgtacttaccgtaagttaccggtttacccgtaccccgtttaagttacccgttttacggggacccggtaaacggggtaacctaacggtcgttaaacggaaacttacccgggaaaacgtcggtttacggacgttaccgtccgtaccgtaacttacgttccgttaccggtttaccttaccgtttaacccgtaccccgttccccgtacttaacgtttacg

SEQ ID NO: 71545 - DNA, 977 bp, Homo sapiens
  misc_feature: GYAE6OF01DAGZU.44.59.F04.1.454.CMB.1.raw
tcagacagtatatacacgaccggtgctcgatttagtacacacacttagggattgggggcatgagtcagaccctgtcgaggggacagcatggacagtggacgggtccccgctcagcctccgtggggctcctgctgctcgtcggcctccgtaggttcgagtatggtagactatcggaagactaccggaccctcgttccttcccctttccttccttcgtttcctttcgttacgttggtaggggacggtacgtacggtaccgttaccaacctcgtaccgtacgtcgggaccgggacgttacgcggttacggttcggtttcggtcgtacggttggttcgtaccgttaacgggttaacgaaaaacggggtaaaaggggcgtaccggtaaccggttaacgttcccgtggtaccctttacgaaccggtaacgaaaccgtaggtacggttaaggaaacggtacggtccgttacccgtagttacggtagcgttaccgaccgtacggtaccgggtagggttccggtacggggactaccgtccgtaaacgtccaaccgtacgttaacgtccggaccgtaccgtccggtaacggtaccggtaagtaacggttaccgttccggtaacttaaaccgtttaaacccgtttttgttaacccgggtaacgttaaccgtacgggtaaacgtttaacccggtaactttaaaccggttcggttaacccggttttcccgggtttaaacccccgggtttgtttaaaacccggggttttaccgggaccccgggtaaaaccggggtttaccaaaccgggggtaactttaaaaccggggtaaaccgtaccggggttaaaaaaccccggtgttaccccgggggttaagaaccccggttaaagggaaccccttttacccgaacggttttacccgtttaacgttaaccctaaccccggttttaacttttcccccgggtaaaacccccgccgtttaaattaacccgg

SEQ ID NO: 71546 - DNA, 738 bp, Homo sapiens
  misc_feature: GYAE6OF01AXMV9.44.59.F04.1.454.CMB.1.raw
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
tcagacagtatatacacgaccggtgctcgatttagtacacacacttagggattgggggcatgagtcagaccctgtcaggggacagcatggacatgagggtcccccgctcagctcctggggctcctgctgctctggctcccaggttcgagatgtgacatcgagatgacccagtctccttccttcctgtcttcttctggttggaggcagccgtcaccatcacttggccgggcagtcaggttcgttttcggnctgttcgcctggttacaagaaaagggggnacggccctaaggtcctcgtctctcgtagaaaccngactggaaggtagacgtcccgtacaggttcagtcgccgagtccgaggtcggtcgggccgagtcccacttcaccaaccgtattacggccgtaccgttggccggtacctaggtaacgtctttcgtagtacccttaaactttacgttttccgacgtttaccgagtaccgtaagttaccgtacgtaacgttaacggttcccgttacccccggttttgttaacccggtttttacggggaccccggttaaccgggggaaaccctaaacgggttaccggttaacggaaaaccttaaccggtaaaaccggtaccgtttacggggtaggtacccgttaacgggtacccctaaccgttcgtttacccgttcccggttttacctttacccgtacccttttacccccgttaccccggttacccttacgtttaacccgg

SEQ ID NO: 71547 - DNA, 651 bp, Homo sapiens
  misc_feature: GYAE6OF01BT69H.44.59.F04.1.454.CMB.1.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgccttggtttaccaacgaaaaagggggngacggacccctaaggtcctacggtctctcgtagaaacccagactaggaaggtagacgtcccgtcaggttcagtcgcctagtccaggtgtggggccggagtcccactctcacctattcgcgacctggccggcctagaagtattcgtgacaacgtttatttctgtcagctagttactctagtagtccgtccccgttctaccgttttcggacccgtacgggggtaacccaaggtctacgggaaactaccgtaaaaaccggtacgttaggtaacgggtccttaacggacccgtaaacccgtcgttaccgtttacgtttcccgttaacccttaactttccccgttttaccccccggtacccctaagtttaccccgg

SEQ ID NO: 71548 - DNA, 926 bp, Homo sapiens
  misc_feature: GYAE6OF01ESBON.44.59.F04.1.454.CMB.1.raw
tcagacagtatatacacgaccggtgctcgatttagtacacacacttagggattgggtgcatgagtcagaccctgtcgagggggacagcatggacatgacgggtccccgctcagcctccgtggggcctcctggctgctcgtggtcctcccgaggttcgagtattggtagactactcggagtactacggaaccctaacgttcccttccccttttcctttccgttgtttcctttctttacgttggttgggacggcgtacgtccgtaccaaccgtactccgtaccgttcgggacccgggtacgtacggttccggtacgggttttccggttttcgggtcggttcgttacgggtttcgtaccggttttacggtttaaaccggaaaaacggggtaaaaacggggggtccgtaacccggggttacccccgttaaacgggttccccgttaccggtttacgtccgttaacggtaaccgtaaaccggtacggtacggttacgggaaaggttccggtaccgtaccccgttcggtagttcgtacgcgtaccgtcggtacggtaggggtcgggtacgggtacccggtctaacccgcttacccgactaaccgtaggttaccggccgtacccggtcggtaccggtacgtaagtaaccgttcttaccgaacgttacctttaacgtttcttacggtcgtacgacgttacgtaagttactccgttagttaccggttcccgtacccgtttacgttaccgggttaccgaccggggtaaccgggtaacttaacgggtaccgtaaaacgggttaacctaaccggttaaaaccggtcggggttaccggaccggtttcccgtaacccggtacccgttaaacgttccgttccgtttaccgggtttacccttacggttaaccccctttccccggttaaacccgtcgttaaacc

SEQ ID NO: 71549 - DNA, 748 bp, Homo sapiens
  misc_feature: GYAE6OF01C41FJ.44.59.F04.1.454.CMB.1.raw
  modified_base (106)..(106): a, c, t, g, unknown or other
  misc_feature (106)..(106): n is a, c, g, or t
  modified_base (162)..(162): a, c, t, g, unknown or other
  misc_feature (162)..(162): n is a, c, g, or t
  modified_base (169)..(169): a, c, t, g, unknown or other
  misc_feature (169)..(169): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (329)..(329): a, c, t, g, unknown or other
  misc_feature (329)..(329): n is a, c, g, or t
  modified_base (447)..(447): a, c, t, g, unknown or other
  misc_feature (447)..(447): n is a, c, g, or t
  modified_base (522)..(522): a, c, t, g, unknown or other
  misc_feature (522)..(522): n is a, c, g, or t
tcagacagtatatacacgaccggtgctcgatttagtacacacacttagggattgggggcatgagtcagaccctgtcaggggacagcatggacatgagggtccccgntcagctcctggggctcctgctgctctggctcccaggttcgagatgtgacatcgagntcgaccngtctccttctctgtctcttctgtgagcagcgtcacntcacgttggccggngtagtcgtacgggttcgtttggtgtcttagttcgccttaggttaaccaaaacggaaaagggggtcacggtaccccgtaaggttcctcggtccttcgtacggtagaaaccngaacgtgggaagtacgtacgtcccgtagaggttcacggtcgacccgtaggttcccggaggggttcggggtacggggtccccgtaagttcccctaactttcccgaaccgtaaccggttnttaaccgggccgtaacccgttcgggaccggttaccgtaggtaactacgtttacgtacgtaaccttaaacgttttnttccgtacgtttacgacgtaccgtaacgtacgtaccgtacgtttaccggtcccggttacccccgtttaggttcccggttttacgggacccggtaacgggggtaacccttacgggtaccggttaaaggaaccttaaaccggtaaaccgtacggttggtacggtcctaggaccctacggtacttccgtacgttaccttaccgtctttaccccgtccacgttcgttacg

SEQ ID NO: 71550 - DNA, 806 bp, Homo sapiens
  misc_feature: GYAE6OF01CDW9I.44.59.F04.1.454.CMB.1.raw
  modified_base (106)..(106): a, c, t, g, unknown or other
  misc_feature (106)..(106): n is a, c, g, or t
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (337)..(337): a, c, t, g, unknown or other
  misc_feature (337)..(337): n is a, c, g, or t
tcagacagtatatacacgaccggtgctcgatttagtacacacacttagggattgggggcatgagtcagaccctgtcaggggacagcatggacatgagggtccccgntcagctcctggggctcctgctgctctggctcccaggttcgagatgtgacatcgagatcgacccagtctccttccttcctgtcttcttctgttggagcagcgtcaccatcacgttcgccgggngacgtcgtggttcgttttcggngcttggttacgtccgttaggtttacaaaacggaaaagggggtcgaccggtacccgtaaggtccctcgttctcgtcgtacgaaaccgngtacgtagggtaaggtacgtcggtcccgtcgtaggttcaagtcgaccgtacggtccgagggttcgggtcggggacccggtacgtccctacgttcctaccgtaacctacgttacggccgtaccgtccgggtccggtaccctagggtaacttacgtttccgtacggtacctttaaacttttacgtttccgtagttaccgacgtaccgttaacgttacttaccgttaacggttaccggtttcccggtacccccggtttttactaaccgggtttttccgggaaccccgggttaaccgggggtaacccgttaaacggttacccgtaaaaggggttaaaccttaacccggaaaaacgttaaccgggttccgggtaacggtacccggttaccggaccctaacccgttacggttcccgttacgtttacccgttaccttacccggttaccctttaccccgggacttacggtttacccg

SEQ ID NO: 71551 - DNA, 847 bp, Homo sapiens
  misc_feature: GYAE6OF01C7PYM.44.59.F04.1.454.CMB.1.raw
  modified_base (106)..(106): a, c, t, g, unknown or other
  misc_feature (106)..(106): n is a, c, g, or t
  modified_base (160)..(160): a, c, t, g, unknown or other
  misc_feature (160)..(160): n is a, c, g, or t
  modified_base (296)..(296): a, c, t, g, unknown or other
  misc_feature (296)..(296): n is a, c, g, or t
  modified_base (760)..(760): a, c, t, g, unknown or other
  misc_feature (760)..(760): n is a, c, g, or t
tcagacagtatatacacgaccggtgctcgatttagtacacacacttagggattgggggcatgagtcagaccctgtcaggggacagcatggacatgagggtccccgntcagctccgtggggctcctgctgctctggcctcccaggttcgagtatcgtgacngtacgagatcgacccgagttccttccgtttcccttcttgttctttcttcgttggttgggcgtcacggtccgtaccacctacgtccgtaccgttccgggccgggacgtacggttcgtacgggttttcggttttcggngtccgtttgttccggtccgttacggttaacgaaaaacgggaaagggggtacaccggtaccccgtagtcccgtcgtccttcgtacgtaacgaaccgtagtacgtacgggaaggtaccgtacggtccctacggtacggtcgacgtcgaccgtggtaccggaggttcgggtcgggacgtacgtaccctacgttcctacgtaaccgtagtaccggaccggttaccgtcggggtaccgggttaccgttaagggaacttccgtttaccgtaacgtttaccgttttaaacttttcggtttaacgttcgtaaaccgttaggtacccgtttaaatccgtttaacgttaccggttaacccggtttcccgggttaccccccgttttaaggttttaccggtttacccggggaaacggtaccgggttaaccgtaaggtaacccggttaagtaaaaacccgtccgtaaacgggttacncgggttacgtaacccgtaacgtacccgtaacgttcctctttacgtttaccctcgttacccccttcccggtaccctagttagtacccg

SEQ ID NO: 71552 - DNA, 848 bp, Homo sapiens
  misc_feature: GYAE6OF01CWY93.44.59.F04.1.454.CMB.1.raw
  modified_base (279)..(279): a, c, t, g, unknown or other
  misc_feature (279)..(279): n is a, c, g, or t
  modified_base (836)..(836): a, c, t, g, unknown or other
  misc_feature (836)..(836): n is a, c, g, or t
tcagacagtatatacacgaccggtgctcgatttagtacacacacttagggattgggggcatgagtcagaccctgtcaggggacagcatggacatgagggtcccccgctcagctccgtggggctcctgctgcctctggcctcccgaggttcgagatgtgacatacgagatcgaccctagtcctccttccttccttgtcctttcttcgtggttggacgcacgtccgaccacctatcctacgttcgggccgggacgtagtcgttacgggtttcgttttcggngtccttggttccgtccgtttagggttaaccgaaaaacgggaaaaggggggacgtaacccggtaccccgttaacggttccccgtaccgttccgtccgttaccggtaacgaaaccgaggtaaccggtagggtaaacggtcggtaccggttaccccgttacgtaacgggtttccacggtaccgccgtaaggtcccggtaggggtcggggtcccggggaccggtacgtcccctaacgttcctaacccgtaccgtaggttaccgacccggtaccgttcgggaccggtacgtaacggtaacgttctttaccggtacgtaaccgtttaaaccgttttcgtttaccggtagtaccgtaacgtacgtaacgtttaacctacgtaacggtttcccgttaccccgttaccccggttttactttaaccgggttacgggacccggtaacggggtaactacggtacggtaaacggtaacgtaaaccggtaaacggtacgttcggcgtaccgacgaccctacgttacttccggttacttcccgttaaccgttacccttccccgttaacccgntacgtttaccgg

SEQ ID NO: 71553 - DNA, 771 bp, Homo sapiens
  misc_feature: GYAE6OF01DUBNU.44.59.F04.1.454.CMB.1.raw
  modified_base (252)..(252): a, c, t, g, unknown or other
  misc_feature (252)..(252): n is a, c, g, or t
  modified_base (758)..(758): a, c, t, g, unknown or other
  misc_feature (758)..(758): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagttcctccttccttcctgtcttcttctgttggagcagcgtcaccatcacttcggccggcgagtcgtaggttcggttttcggntcgttgttcgccgtttaggtttaaccgaaaaacggaaaaaggggggcgtaaccgggtaccccttaaacgggttcccctacggttcctccgttcggtaacgaaaccgagtaacgtaggggaaggtacgacggttcccgtacgtacggttcgaggtcgcctagtccgtagggtcgggtcgggaccggtacgtcctaactcctaccgacctacgttaccggaccgtaccgtcggaccgtaccgtagaacggttctttccgtacgttaacctttaaacgtttttcgtttccgtagttaccgtacgtacgtaacgttactactaagtttaccgggtaccctttacccccgggtttacttaccgggttttcgggaaccggtaaccggggtaacctaacggtcttaaacgggtaacctaaccggtaaacgtcgttacggacgtaccgtacggaaccctactaacgtttccgtacgtttacccttacccgtacgtttaccccccgttaccccgnttaacgttacccg

SEQ ID NO: 71554 - DNA, 763 bp, Homo sapiens
  misc_feature: GYAE6OF01BOL3S.44.59.F04.1.454.CMB.1.raw
  modified_base (174)..(174): a, c, t, g, unknown or other
  misc_feature (174)..(174): n is a, c, g, or t
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
tcagacagtatatacacgaccggtgctcgatttagtacacacacttagggattgggggcatgagtcagaccctgtcaggggacagcatggacatgagggtccccgctcagcctccgtggggctcctgctgctctggcctcccgaggttcgagatgtgacatcgagatcgacccngtcctccttcctctgtcttcttctgtggacgcagcgtcacntcacgtcggccggngagtctagggttcgtttcggngtcttgttcgtccgttaggttaaccgaaaacggaaaaagggggcgaccggtacccgttaaggtcccgttcgtccgtaccgtaccggtaacgaaaccgtacggacgttaagggaacgtacggtaccggtccccgtacgtaggttccaggttccggaccgtacgtaccggtagggtcgggtacggggacccggtacgtcccgtaccgttaccgtaccgtaaccgtacggttaccggacccgttaccgtcgggaccgtaccgtaggaacgttactttcgacgtaacctttaaacgtttacttcgttacgtacgtagtaccgttaagttactaccttacgttaccgggttaccgtttcccccgtttagtttacccggttacccgggtaccggtaaccgggtaaccgtaacgtacggtaacggtaaacctacccgaaacggttacgtaggtccgtacgtctacccgtacctagtccctttacggtccttactacccttcccgtacccctgtacttacg

SEQ ID NO: 71555 - DNA, 660 bp, Homo sapiens
  misc_feature: GYAE6OF01BGAG0.44.59.F04.1.454.CMB.1.raw
  modified_base (284)..(284): a, c, t, g, unknown or other
  misc_feature (284)..(284): n is a, c, g, or t
  modified_base (622)..(622): a, c, t, g, unknown or other
  misc_feature (622)..(622): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacgttcggccgggcgagtcgaggttcgttttcggtgcttgttgccgttggttacaaacgaaaagggggnacggaccctaaggtcctcgtctcgtacgtacgaaaccagacgtgggaagtaggaccgttcccgtccgtaggtttcgagtcgaccagtccgagggtcggtcgggcccggtacgtccgtacttcctaccaaccctaagtttacggacccgtaccgtggacccgggtcctaggtaaaggttactttcgtacgtaccttaaaccttttagtttcgtcgttacacgtctaagttactactacgttacgttccggtacccttcgttaccgttttacgggccgtaacggggtacctaagtccgtaaggaactaacgaaacgtacgtgtacggctcgaccaccgtnttcgtacttcttcaacttccccgtccctccgtattacg

SEQ ID NO: 71556 - DNA, 615 bp, Homo sapiens
  misc_feature: GYAE6OF01ALSDQ.44.59.F04.1.454.CMB.1.raw
  modified_base (256)..(256): a, c, t, g, unknown or other
  misc_feature (256)..(256): n is a, c, g, or t
  modified_base (577)..(577): a, c, t, g, unknown or other
  misc_feature (577)..(577): n is a, c, g, or t
tcagacagtatatacacgaccggtgctcgatttagtacacacacttagggattgggggcatgagtcagaccctgtcaggggacagcatggacatgagggtcccccgctcagctcctggggctcctgctgctctggcctccaggttagagatgtgacagtcgagatcgacccagtccttccttccttctgtcttcttctgtgagcagccgtcactatctacgttggccggacgtagtcgtaggtttcggttttcggngtcttggttcgccgttaggttacgaaaacgggaaaaggggcgaccggtacccgtacggtcctcgttctcgtacgtacgaaccgtgacgtagggacggtagaccgtccgtactaggttcagtcgccgtagtccggaggtgggaccgggaccgtacgtcccacgtctcaacgtacgtacgcgaccgtggacgcgtagacgtattcgcgtactactttattcgtcgtcgagctagtactacgtagtcgtccgtaccttacgttcgtttacggaccggtacgggtaccacggtacgtaacgaactacgaaacgtgtcgtacgtcncgcctagcttcgtacttcctcaccttccactcgtctag

SEQ ID NO: 71557 - DNA, 765 bp, Homo sapiens
  misc_feature: GYAE6OF01AUPSV.44.59.F04.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
tcagacagtatatacacgaccggtgctcgatttagtacacacacttagggattgggggcatgagtcagaccctgtcaggggacagcatggacatgagggtcccccgctcagctcctggggctcctgctgctctggcctcccgaggttcgagatgtgacatcgagatgacccagtcctcccttcctcctgtcttctctgttggngcngcncacntcacgttcggccggcgtagtcgtacgggttcggttttcggtgtcgttggttcgtcccgttagggttaaccgaaaacgggtaaaaagggggacgaccggtccccgtaaggttcccgtcggttcctcgtaccggtacgaaaccgaggtacggtagggaacggtacgaccggttaccccggtccgtaggttcgacggtccgaccgtacggtccggtagggtcggggtccgggtacccggtacgtacccgtaccttaccgtacctaacccgtacgtaccgacccggtacgttccgggcccggttacgtagtaacgttaccttaccggtacgttaactttacgtttacttcggtacgtacgcctaaccgttaagttacctaccgtaacgtttcccggttacccccggttaccttttaccggttaccggttaacggacccggggtaaccgtacgtacgtacgtaacgtaacgtaaccgaacggtgttaccggcgtacctccgaacccttatccgttcgagtttacctaccggtacctaccccggaccctgtccttacg

SEQ ID NO: 71558 - DNA, 947 bp, Homo sapiens
  misc_feature: GYAE6OF01BLB2D.44.59.F04.1.454.CMB.1.raw
tcagacagtatatacacgaccggtgctcgatttagtacacacacttagggagttgggggcatgagtcagaccctgtcaggggacagcatggacatgagggtccccgctcagcctccgtggggctcctgctcgctcgtcggcctcccgaggttcgagtatgtcgacatcgagtatcgaccctagtccttccctttccgtttcctgttcctttaccttcgtggttaggacggctaggccgtaccacctatccgtacgttcggcccgggtactacgttcgtaggtttccggttttcggcgtcgttgttccgtccgtttaggttaaccgaaaaacgggaaaagggggtcgaacccggtacccggttacggttcccgtacgttctaccgtaggtaacgaaacccgtagtccggttaagggaacggttacgtccggtaccccgttcggaagtttcccgagttccggacccgttacggtccggtaggggtcggggtacgggaccccgtcgtacccgtaccgttcctaccgtaaccgttaacggttcccgaccccggttaacccggtcggggtacccgttaacgtaggttaaacgttccgtttaccggttacgtaaaccccgtttttaaactttttccgttacccgggtaccgttaaacggtaccgttacgtaacgtttacgttaacccgtaccggttttacccggtcccccgttttacccgggtttacctttacggggtttaccccgggaaccggggtttaaaccgggaaacccgttaacgggttacccgtttaaacgggaaaacccgttaaccggtaaaaccggggttccctttacgggggaaccgttaccccgttaacgggacccgtttaaacttcccgttaacccgttttcggttaccctttaacccgtttcccccggtacccgtttaccccgaccttttcggttaaccgg

SEQ ID NO: 71559 - DNA, 651 bp, Homo sapiens
  misc_feature: GYAE6OF01CTAE3.44.59.F04.1.454.CMB.1.raw
  modified_base (371)..(371): a, c, t, g, unknown or other
  misc_feature (371)..(371): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccgaggttcgagatgtgacatcgagatcgacccagtcctcccttccttcctgtccttcttctgtggagcagtcgtcacctatccacgttcggccggtgagtcgtaggttcgtttcggtgtctgttcgcgttcggttaacaaaacggaaaagggggtacgacggtacccgtaacggtcctcgtcgtctcgtacgaaaccagtacgtaggaagtcgacgtcccgtacgtagttcgngtcgaccgagtccggagggtcgggtcgggaccgggtactccacttcacgtacctagttacgaccgcgtcggccgtcctagaagtcttcgtcgacttaacgtttctttacgtgtaccgagtaccgtatactcgtagtcgttccgtacccgtttataccgtttcggaaccgtacggggtaccagtacgaacgtataaccgaaacggtactcggtgaccgtacggaccctacgtagttaccttcgttacctaccgtacctttccccgtacccgtctcgttacg

SEQ ID NO: 71560 - DNA, 1077 bp, Homo sapiens
  misc_feature: GYAE6OF01EBB7A.44.59.F04.1.454.CMB.1.raw
tcagacagtatatacacgaccggtgctcgatttagtacacacacttagggattggggagcttcagctgtggtagagaagacaggattcaggacaatctccagcatggccggcttccctctcctcctccaccctcctcactcactgtcgcgacgggtcctcgggcccagtcctggggtcgctgactcgacgccacttcctcgacggtccggttccggtacccggggaccccccgggcaacgggtaccggttccgtaacggttaacttttccgttttttcggttaccggtagggtaaaccgggttaccggtaaccctaaacgtaggttaaccggtaaaagtttaaacgtttaaccggttaacttacggttaggttaacgttccggaacttaaacgttccaaacggtaacgggaccggtaccccggtacccccgaaccgtacccccttacgtacgtttaaccggtaaggtaacggggaaactaacgtccggaacggtcccgggtaccctacggtaccggggttccacgtacccgtacgtttcctcgtaccgtaccctacgtaacggttccgtccggaccctaacccgttaccgacccgttccccttaccggtaccgtacccttaccggtcgtaaccgggggttccccgggtcccggttacccggggttaaaccgggtacgggttaacggcgggttaaaccggttacccggtttaggtttaaaccgtttttcccgtttttacgggtacgggttccggggttaccggttttcggggtttaacggggtaacctaacgggttaccgttaaccgtttccggggttaacggggttaacgtttacccggggtactttacccggggtttaaaccgggtttacccggggacccggggggttaaaccggggaacccggggttaaaccggtaaacccgggggttaccgggtttaaccccgggttaaacccccgggtttaaacccggtttaaacccgggtaccccggttaaacccccggggttaaaccggggtaaaccccggtttccccgggtttaccccccccgggtcccccccgggttttaaacccgggg

SEQ ID NO: 71561 - DNA, 820 bp, Homo sapiens
  misc_feature: GYAE6OF01BT8X4.44.59.F04.1.454.CMB.1.raw
  modified_base (152)..(152): a, c, t, g, unknown or other
  misc_feature (152)..(152): n is a, c, g, or t
  modified_base (160)..(160): a, c, t, g, unknown or other
  misc_feature (160)..(160): n is a, c, g, or t
  modified_base (774)..(774): a, c, t, g, unknown or other
  misc_feature (774)..(774): n is a, c, g, or t
tcagacagtatatacacgaccggtgctcgatttagtacacacacttagggattgggggcatgagtcagaccctgtcgaggggacagcagtggacatgacgggtccccgctcagctccgtggggctcctgctgctctgcctccgaggttcagnttgtgacntcggagtatcgacccagttcctccctttccttcgttcgttcttcttcgtggttgggacggtcagtccgtaccaacctacttctaccgttcgggcccgggtcgtaacggttcgtacggggttttccggttttcggtagtccgttaggttcggtccgttttaggtttaaccgaaaacggggtaaacggggacgtaccggtacccgtaacggttcccgtcggtcttccgtacggaacgaacccgaggtacgtacggggaaggttaccggtccggttccccggtacggttaggttccggtagtccggtacccgtacggtaccggtggggttacggggtaccgggaccgggtcctaccaccggttacctaccaacgttacgtaccgcgccgttcgggcgtacgtaagtacttacgttccgtacgttaacgttacttttcgttcgttacgtacgtacgtacgttagtaccttacgtacttaccgttcccggtttacctttacgttaccgggttttccgggaacccgggttaccggaactttaccggaacgtaacggtaacgtaaaccgtaaacgtacggtgggtaccgcccgttaacggacctacgttacgttccgtttnttacccggttcctaccggtttaccctcccggtaactcgttaaaccg

SEQ ID NO: 71562 - DNA, 871 bp, Homo sapiens
  misc_feature: GYAE6OF01B87ZR.44.59.F04.1.454.CMB.1.raw
  modified_base (222)..(222): a, c, t, g, unknown or other
  misc_feature (222)..(222): n is a, c, g, or t
  modified_base (360)..(360): a, c, t, g, unknown or other
  misc_feature (360)..(360): n is a, c, g, or t
tcagacagtatatacacgaccggtgctcgatttagtacacacacttagggattgggggcatgagtcagaccctgtcaggggacagcatggacatggacgggtcccccgctcagctccgtggggcctcctgctgctctcggcctcccgaggttcgagatgtcgacatcgagatcgacccagtcctcccttccttctgtcttcttcgtggtggagcagctcacntcacgtcgccgggctagtcgtagggtttccgtttggcgtcgttggttcgtccgtttaggttaacgaaaaacgggaaaagggggccgaaccgggtcccctaagggttcccttcgtctaccgtacggtaacgaaaaccgngtaacggtacggaaaggtacgaccgtacccggtcgtacggttcacggtcgaccgtaacggtccggtaggggttcggggtacgggacccgggtaattccccgaacgttccctaaccgtaacccgtagttaacccggaccgtacccggtcggtaccggtacccggttaaggtaaacgttccgttttaccggtacgttaacccgtttaaaccttttaacgttttacggttaaccggtttacgaacgttaaccgttaaacggttaattaccgttaacgtttaacccggttccgtttaccccccggttttaacgttttacccgggttttaaccgggaaccccggggtaaacggggtaacccgtaaacggtaacggttaacggtaaaaccgtaaacccgtaaacgggtaaccgttacgggacgggttacccgaacgtacccgtaaccgttcgttccctttaccgttacccttttaccggtacccttaccccggtttacccccaacgttacgttaccg

SEQ ID NO: 71563 - DNA, 877 bp, Homo sapiens
  misc_feature: GYAE6OF01B3WBE.44.59.F04.1.454.CMB.1.raw
  modified_base (634)..(634): a, c, t, g, unknown or other
  misc_feature (634)..(634): n is a, c, g, or t
  modified_base (742)..(742): a, c, t, g, unknown or other
  misc_feature (742)..(742): n is a, c, g, or t
  modified_base (839)..(839): a, c, t, g, unknown or other
  misc_feature (839)..(839): n is a, c, g, or t
tcagacagtatatacacgaccggtgctcgatttagtacacacacttagggattgggggcatgagtcagaccctgtcaggggacagcatggacagtgacgggtccccgctcagcctccgtggggctcctgctgctcgtcggcctccgtaggttcgagtatgtacgacagttcggaagtactaccgaacccgtacgtttccttccctttacctttccttcgtttaccttttccgtttcgttgggtacggacggtacgacgtacctacgaacctagttaccgtacgttccgggaccgggtacgtaacggtccggttagggttttcggtttccggtgtcgttgttccgtaccgtttaggtaaaccgaaaaacgggtaaggggtacacccggtaccgttagtcctcgtcgttcgacgtaacgaacgagtaccggtaggtaaacgtccggaccgttccgtgtaacggtacacgtccggtacctacggtcgggtagggttccggacgggtaccgaaccttcaacccgttctaccggtaccgttaacgttaccggacccgttacccggtaggtaacccgttagtacggtaacctttagtttacccggtactttaaacctttaactttaccggttccggtaanaacccggttagtaacttaacgttaacgttacgtaaccgtttcccggttacccggtttacccttaacgttttccggggaaccggtaacccgggaaacgggttaacccgngtttaaccggtaaaaccgtaggttaaacccgtaaacggtttcggccgggtaaacccttgaaaccccgttataaccgggttcttacggttttaccccngtttacccctcgtttaccccacctaggtattttaaccc

SEQ ID NO: 71564 - DNA, 514 bp, Homo sapiens
  misc_feature: GYAE6OF02GSSUQ.44.59.F04.1.454.CMB.1.raw
  modified_base (275)..(275): a, c, t, g, unknown or other
  misc_feature (275)..(275): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccagactggaaggtagagtcccgtcaggttcagtgccagtccaggtggtgggccggagtccactctcaccattagcgacctgcggcctgaagattctgcaacttatttctgtcagcagtatcatagtcgccccgttcacgttttggccaggggaccaaggctaggaaatcaaacgactgtgctgcacatctgtcttcattctccgcatc

SEQ ID NO: 71565 - DNA, 520 bp, Homo sapiens
  misc_feature: GYAE6OF02IZQO2.44.59.F04.1.454.CMB.1.raw
tcagacagtatatacacgaccggtgctcgatttagtacacacacttagggattggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtgccgacattaggactttttggcctggtttcagcaggagcctggcaaagcccctaagtccctgatcttttctggatccactttgaagtagtggagtcccagccaggttcagcggcagtggttctgggacacatttcactctcaccatcagcagcctgcagcctggagatttcgcgtactttattactgaccaactaattattccttttttaatcccgttactagttttcggcctaggggacctaagctggagtatacgaaaggactagtggctgctacattctgttctctac

SEQ ID NO: 71566 - DNA, 589 bp, Homo sapiens
  misc_feature: GYAE6OF02JJTAU.44.59.F04.1.454.CMB.1.raw
  modified_base (279)..(279): a, c, t, g, unknown or other
  misc_feature (279)..(279): n is a, c, g, or t
  modified_base (313)..(313): a, c, t, g, unknown or other
  misc_feature (313)..(313): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttacaaacgaaaagggggngaggcccctaaggtcctgtctctcgtagaaaccngactggaaggtagacgtcccgtcaggttcagtgccagtccgaggtggtcgggccgagtccactctcactattacgccgacctggccggtcctaggaacgtattcgtgtactaactttatttcgtgtcagctagtatacattacgtcgcccgtttctacgttttcggacccgtaggggaacccaaggtcctaaggaaactaccgaaacgtacgtaggtcggtaccgtgacctaccgtattccgttgttaccttcctattcccttcccgcctattccg

SEQ ID NO: 71567 - DNA, 558 bp, Homo sapiens
  misc_feature: GYAE6OF02IL2Q6.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
  modified_base (458)..(458): a, c, t, g, unknown or other
  misc_feature (458)..(458): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaagggggnaggcccctaaggtcctcgtctctcgtagaaaccngactggaaggtagacgtcccgtcaggttcagtgccagtccgaggtggtgggccggagtccactctcactattacgccgtacctggccggctagaacgtacttctgactaactttattctgtcagctagttatcatagtccgtcccgttntaccgtttcggaccgtacgggaccaagcgtaaggaaactacaaacgtacgtgtacgcgtcgaccacctattctgttcttcacttcccgttccgcctatcg

SEQ ID NO: 71568 - DNA, 630 bp, Homo sapiens
  misc_feature: GYAE6OF02JE1J6.44.59.F04.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
tcagacagtatatacacgaccggtgctcgatttagtacacacacttagggagttggggacatcgagtcagaccctcgtcagggacagcatggacatgagggtccccgctcagctcctggggcttcctgctgctctggctcccaggttccgagatgtgacatcgagatgacccagtctccttccttcctgtcttcttctgttggaggcagcgtcaccatcacttgccgggngagtcaggtcgttttcggngctgttgcccgttggtttacaaacgaaaaagggggtcgaggcccctaagggtccctcgtactcgtcgtagaaaccagactggaagtagacgtcccgtcaggttcagtcgccagtccaggtggtcggaccggagtccactctcacctagttagccgacctgccggcctagaacgtacttcgtcgacctaacgtttactttctgtccagtctaaggtactcgatacggtccgtccccgttactaaccgttttcgggacccgtacggggtaacccaagtccgttaggaaacttaccgaaagtaaccgtggtacggacttggtaccaacctacgttccgttcgttaccttaccgtaacttcccgttaccccgaccgtacttaccg

SEQ ID NO: 71569 - DNA, 556 bp, Homo sapiens
  misc_feature: GYAE6OF02I2F6P.44.59.F04.1.454.CMB.1.raw
  modified_base (274)..(274): a, c, t, g, unknown or other
  misc_feature (274)..(274): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggtttcaacaaaaagggggnaggcccctaaggtcctcgtctctcgtgaaaccagactggaaggtagagtcccgtcaggttcagtgccagtccaggtggtgggccggagtccactctcaccattacgcgacctgcggcctgaagattctgcaacttatttctgtcagcagtatcatagtcgccccgttctacgttttcggcccgtagggggacccaagtccgtaggaaactacgaaacgtaactcggtaggccgtcggccaaccattccttgttacctttcacttccttccccgcctattccg

SEQ ID NO: 71570 - DNA, 549 bp, Homo sapiens
  misc_feature: GYAE6OF02GP3GR.44.59.F04.1.454.CMB.1.raw
  modified_base (278)..(278): a, c, t, g, unknown or other
  misc_feature (278)..(278): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttcaaacgaaaagggggngacggcccctaaggtcctcgtctctcgtgaaaccagactggaaggtagacgtcccgtcaggttcagtgccagtccaggtggtgggccggagtccactctcacctattacgccgacctgcggcctgaagtattctgactaacttatttctgtcagctagtatcatacgtcgtcccgttctacgttttcgggaccgtaggggacccaagtcctaaggaaactacgaaacgaactgtggctgaccaccattctgttcttcattcctcccgcatc

SEQ ID NO: 71571 - DNA, 578 bp, Homo sapiens
  misc_feature: GYAE6OF02INZ1K.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttcctccctgtctgcttctataggagacagagtcgccatcacttgccgggcaagtcagaccattaacagctatttaaattggtatcagcagagaccaggaaagcccctgaactcctgatctctgctgcctccactctgcaaggtgagtctcttcaaggttcagtgcagtgatctggacagatttcactctcacatctccagtctgcaactgaagtattttgactaactttactacttgtacctaaactagtaacgtttaataaccgttcgtcccccgtttacgtaaccgtttttcggggtaccggggggtaacctaaacgggtccgttaaggggaacgtaacgttaccgtaaaaaccggtaacgttacggttacgggaccgttacggaccctaacccgtaacg

SEQ ID NO: 71572 - DNA, 515 bp, Homo sapiens
  misc_feature: GYAE6OF02H0KEA.44.59.F04.1.454.CMB.1.raw
tcagacagtatatacacgaccggtgctcgatttagtacacacacttagggattggggagcttcagctgtggtagagaagacaggattcaggacaatctccagcatggccggcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggcacggccccccgactccttatctatgctactaatcagcgcctcagggtccctgcccgatctctggctccaatctgcactcagctacctgccatccttgatctccagtctggaggatggaggctagatttactactgtgcagcagtgggatgacaggccgaaggctgggtgtcggcggaggaccgaagttcgaccgtcgtagtcacgcccgaaggctcgcccccgtggtcc

SEQ ID NO: 71573 - DNA, 660 bp, Homo sapiens
  misc_feature: GYAE6OF02J2RWX.44.59.F04.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
tcagacagtatatacacgaccggtgctcgatttagtacacacacttagggagttgggggcgactgagtcagaccctgtcaggggacacgccatggacatggacgggtccccgctcgagctcctggggctcctgctgctctggctacccaggttcgaagatgtgacatcgagatgacccagtctccttcctccngtcttctctgttggagcagcgtcacatcactggccggngagtcaggttcgtttcggnctgttcgccttggttcaacgaaaaggggcacggccctaaggtcctcgtctcgtcgtcgaaaccagactggaaggtnacggtcccgtacgtaggttcgagtcgaccgagtccgaggtggtcggggccggtaggtcccacgtcgtcgaccgtagtttacggcggtacctggccggacctaggaacgtacttcgtacgaccgtaaacttacgtttcgtacgtaccgaagtcctaacgttacctacacgttacggtccgtaccccgtttacgttaaccgtttcgggacccggtaacgggggaaccctaacggtccgtaacggaaactaccgaaaccggtaccgttaggtcgcgttcgacctaccgacttcgtacggttcctttacgaccgtttcctaccccggacttagttccc

SEQ ID NO: 71574 - DNA, 729 bp, Homo sapiens
  misc_feature: GYAE6OF02IBT4N.44.59.F04.1.454.CMB.1.raw
  modified_base (248)..(248): a, c, t, g, unknown or other
  misc_feature (248)..(248): n is a, c, g, or t
tcagacagtatatacacgaccggtgctcgatttagtacacacacttagggattgggggcatgagtcagacccttgtcaggggacagcatggacatgagggtccccgctcagctcctggggctccgtgctgctctggctcccgaggttcgagatgtgacatcgagatgacccagtctccttccttcctgtcttcttctgttggaggcaggctcacatcgacttgccgggcaggtcaggttcttttcggngctgttcgcgttggttacaaaggaaaaggggcgacggtacccgtaaggtcctcgtctcgtcgtacgaaaccagtacgtaggaacggtagacgtcccgtacgtacggttcagtcgccgtacgtccgaggtcgggtcggaccggtagtcccacgttccgtaccgaaccgtaagttacggacccggtaccgtggtccggtaccgtaggtaacgtacgtttcgtacggtaaccttaaacgttttacgtttacgtcgtaccgtaacgtacgttaagttactacgtaacgttacggtccggtaccccggtttacgttaaccggttttcgggacccggtaacggggtaacccgtaacggttccgtaacgggtaaaacttaaccggtaaaacgtaccggttacggtacggtaccgtacgtaccctaccgtacgttacccgttcggttacccttaccgtaccgttacccgttaccccgaccttacgtacg

SEQ ID NO: 71575 - DNA, 573 bp, Homo sapiens
  misc_feature: GYAE6OF02GNC8M.44.59.F04.1.454.CMB.1.raw
  modified_base (246)..(246): a, c, t, g, unknown or other
  misc_feature (246)..(246): n is a, c, g, or t
  modified_base (277)..(277): a, c, t, g, unknown or other
  misc_feature (277)..(277): n is a, c, g, or t
tcagacagtatatacacgaccggtgctcgatttagtacacacacttagggattgggggcatgagtcagaccctgtcaggggacagcatggacatgagggtccccgctcagctcccggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaacgtaaaagggggnaggcccctaaggtcctcgtctctcgtagaaaccagactggaaggtagagtcccgtcaggttcagtgccagtccaggtgtgggccgagtccatctcacattagcgactgcgctgagatctgctaacttattctgtcagcagttatctatagtcgtccccgttctacgttttggcccgtaggggaccctaaggtccttagggaaacttaccgaaaacgtaacgtacggtggccttcggaccaacctacgttacttcgttccttactacttcccttaccccgtcctacttccgttaacg

SEQ ID NO: 71576 - DNA, 666 bp, Homo sapiens
  misc_feature: GYAE6OF02JX7SN.44.59.F04.1.454.CMB.1.raw
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngcttgttgcctggtttacaaacgaaaagggggngacggcccctaaggtcctcgtctctcgtacgaaccagtacgtggaaggtgacgtcccgtcgaggttcagtcgccagtccgaggtggtcgggcgagtccactctcgactagttacgccgtaccgtggccggtcctaggaaacgtacgtttccgtacgaccctaaacgttttacttttcgtacggtccgaaggtctaagttactcgtaacgtttacgtaccgtcccccgttttagtacccgtttttcgggacccgtaagggggtaccctaagggtcgtaacgggaaacttaccgaaaaccgtacgttagggtcggtaccgttacgaccctaaccgtagttaccgttgttaccctttactaccgttccctttaccccgaccttattaccg

SEQ ID NO: 71577 - DNA, 552 bp, Homo sapiens
  misc_feature: GYAE6OF02H43KB.44.59.F04.1.454.CMB.1.raw
  modified_base (275)..(275): a, c, t, g, unknown or other
  misc_feature (275)..(275): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggngaggcccctaaggtcctcgtctctcgtgaaaccagactggaaggtagagtcccgtcaggttcagtgccagtccaggtggtgggccggagtccactctcaccattagcgacctgccggcctgaagattctgcaacttatttctgtcagcagtatcatagtcgtccccgttctacgtttttcggaccgtaggggaaccaacggtctaggaaactacgaaacgaactggtacggctggccaccgattcctgttcttcacttccttcccgtcctattaccg

SEQ ID NO: 71578 - DNA, 558 bp, Homo sapiens
  misc_feature: GYAE6OF02FW3E1.44.59.F04.1.454.CMB.1.raw
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
  modified_base (398)..(398): a, c, t, g, unknown or other
  misc_feature (398)..(398): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggtcgttttcggngctgttgcctggtttcaacgaaaagggggngaggcccctaaggtcctcgtctctcgtgaaaccagactggaaggtagacgtcccgtcaggttcagtcgccagtccaggtggtcgggccggagtccactctcaccattagcgacctgccggcctgaagnttctgactaacttatttctgtcagcagtatactatagtcgtccccgttctacgttttcggccgtaggggaccaaggtcgtaggaaactacgaaaacgtactgtacggtctgcaccgattcctcgttccttctacttccttcccgcctactctagtattac

SEQ ID NO: 71579 - DNA, 586 bp, Homo sapiens
  misc_feature: GYAE6OF02IR03C.44.59.F04.1.454.CMB.1.raw
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (405)..(405): a, c, t, g, unknown or other
  misc_feature (405)..(405): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaaacgaaaaagggggngacggcccctaaggtcctcgtctctcgtgaaaccagactggaagtagacgtcccgtcaggttcagtgccagtccaggtggtgggccgagtccactctcaccattagcgacctgcggcctgaagattcngacaactttattctgtcagcagtatcatagtcgtccccgttctacgttttcggccgacgggggtaccaaggccgttaagggaaacttaccgaaaacgtaaccgttggtacgggtacctggaccacctaacgtccgttacgtttcctttcgtaccttcccgtttccccgtaccctagttccg

SEQ ID NO: 71580 - DNA, 517 bp, Homo sapiens
  misc_feature: GYAE6OF02IAJZR.44.59.F04.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacaaaaagggggnaggcccctaaggtcctcgtctctcgtgaaaccngactggaagtagagtcccgtccaggttcagtgccagtccaggtggtgggccggagtccactctcaccattagcgactgcggctgaagattctgcaactttattctgtcagcagtatcatagtnccccgttnacttttggccaggggaccaagctaggaaatcaaacgactgtggctgaccacatctgtcttcattccttcccgccatcg

SEQ ID NO: 71581 - DNA, 622 bp, Homo sapiens
  misc_feature: GYAE6OF02GQ256.44.59.F04.1.454.CMB.1.raw
  modified_base (191)..(191): a, c, t, g, unknown or other
  misc_feature (191)..(191): n is a, c, g, or t
  modified_base (290)..(290): a, c, t, g, unknown or other
  misc_feature (290)..(290): n is a, c, g, or t
  modified_base (302)..(302): a, c, t, g, unknown or other
  misc_feature (302)..(302): n is a, c, g, or t
tcagacagtatatacacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccatcctcagcgtctgggacccccgggnagacggtcacgatcttttgttctggaagtaggtccaacatcggaagtaattacgtatactggtatcggcaattcacaggagcggtccccagaccccctnatctataggganaatcagcggccctcgacggggtccctgaccgattctctgcctcaagtctggcacctcacgcctccctggcctagtcagtcgggctccgggtccgaggatggacggtctggtatttacgtttctggtcggcggtcgttgggattcggactattccgtggtaggtgggaactggacttagttcgggacgggaacgggacccgtaaggcctacgggacccttacgttaacgtccgaaccggtacccgaacgggccttacccggccccccgttacgggttccctaccgttccgttacccgtttaccccccacccctttaccccg

SEQ ID NO: 71582 - DNA, 687 bp, Homo sapiens
  misc_feature: GYAE6OF02HLVG3.44.59.F04.1.454.CMB.1.raw
tcagacagtatatacacgaccggtgctcgatttagtacacacacttaggaggttgggggcatggagtcagaccctgtcaggggacagcatggacgatgacggtccccgctcacgcctcctgggcttcctgctgctctggctcccaggttcgagatgtgacatcgagactcgaccagtctccttccttcctgtcttctctgtggagtcagcgtcaccgatcacttgccggtcgagtacaggttcgttttcggtgctagttagcttggttcaacgaaaagggcaggccctaaggtcctgtctcgtacgagaaccagactcggaaggtagacgtccgtcgaggttcagtgccacgtccaggtcggtgggaccggtagtccgtacttctaccgtacctaattacgcgtacccgtgggcccgggtactagggaaacggtagttcgtaggaccgtaacgtttagtttacttagttaccgtaggtcttaagtaactacgtaagttagtacgtaccccgttttacgttaacggtttttcggacccggtaacggggtaccgtaaggtaccgttaagggtaaacttaaccgtaaaccgttacgttacggttacggtaccgttaacggaccctaaccgtacgttcccgttggttaccttaccgtacgtttccccgtttccccgaccttacgttacccg

SEQ ID NO: 71583 - DNA, 843 bp, Homo sapiens
  misc_feature: GYAE6OF02JIUPG.44.59.F04.1.454.CMB.1.raw
  modified_base (163)..(163): a, c, t, g, unknown or other
  misc_feature (163)..(163): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagacagtatatacacgaccggtgctcgatttagtacacacacttagggattgggggagcttcagctgtggtagagaagacaggattcaggacaatctccagcatggccggcttccctctcctcctcaccctcctcactcactgtgcaggtcctcgggcccngtctgtcgctgacctcacgcctactcctcgacgtccgtcgtccgggaccccgggnacggtacggtcacgtnttcgttttgtacgtaggaacgtcggtaccaaacgtacgttacgggtaaaactttaacgttacggtaactaacggttaggttacgtaccgggtaactaacgttaccgaacggtacgggtaaccggtaccccgggtaccccctaacggtacccccttagtaacgtttaaccgtaaacgggtaacggggtaacttaaacggttccgaccggggtacccgggtacccccggttagggtaccccgggggttacccgtaaccggttaaccgttaccgtttccgttacccggtacccgttacccggtaacgttaaccggtccgtacccggtaccgtacccgtacccgccgttccccgtccggttaccgtacctacggtaccggtacgggtccgtaccgggtaccggtacgtacggtggtacgtaacgttcgtacgttacgtttgttccggtacggttcggacgtcggtacggtcgtaacgtcgtaccgtcgtacgtcggtacgtcgtacgtacggtcggtaccgggaggtaccgacgtccggtacggttaccggtaccgtaccggtaccgtaccggacccgtaccggtaaccggtcccgtacccgttccgtaccgg

SEQ ID NO: 71584 - DNA, 658 bp, Homo sapiens
  misc_feature: GYAE6OF02J1WVG.44.59.F04.1.454.CMB.1.raw
  modified_base (206)..(206): a, c, t, g, unknown or other
  misc_feature (206)..(206): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (444)..(444): a, c, t, g, unknown or other
  misc_feature (444)..(444): n is a, c, g, or t
  modified_base (498)..(498): a, c, t, g, unknown or other
  misc_feature (498)..(498): n is a, c, g, or t
tcagacagtatatacacgaccggtgctcgatttagtacacacacttagggattggggagcttcagctgtggtagagaagacaggattcaggacaatctccagcatggccggcttccctctcctcctcaccctcctcactcactgtgcagggtcctgggcccagtctgtgctgactcagccatcctcagcgtctgggaccccccggnaggaccggtcacgtnttcgttttgtcngggtaagtcggtcccaaangtcggaaattaacttacgtatacgtggtactcggactaattcacgaggacgccggtaccccaggtacccctctactcgtaagtacgggataactcgacggccgtccctacggtacggggttccccacggtaccgtattccgttcggtcggtctaccgtaacggtcgtcggctaccgttcgacgtccctccgnggtccctatccgtacgtcggtcctaccgacggtctacgaagtcgtcgggaggtnttaactttagtacgtcgacctagttacctagtacgaccgtacgacacgtcctcgtagggttcgggttcgggtcgttcgggacggagggtaccgacggtaccgtcggtaccgttcggtcgggtccaccggtaccggacggtccgtcccggccccgttacgg

SEQ ID NO: 71585 - DNA, 549 bp, Homo sapiens
  misc_feature: GYAE6OF02GYZPD.44.59.F04.1.454.CMB.1.raw
  modified_base (279)..(279): a, c, t, g, unknown or other
  misc_feature (279)..(279): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcagggttcgttttcggtgctgttgccctggtttcaacgaaaaagggggngaggccccctaaggtcctcgtctctcgtgaaaccagactggaaggtagagtcccgtccaggttcagtgccagtccaggtggtgggccggagtccactctcaccattagcgacctgcggtcctgaagattctgctaacttatttctgtcagctagtatcatagtcgtccccgttcacgttttcggccgtaggggacctaaggctaggaaactacgaaacgacttggtggcgtgacctaccgattcttgtcttcacttccttcccgcctatc

SEQ ID NO: 71586 - DNA, 655 bp, Homo sapiens
  misc_feature: GYAE6OF02IALWJ.44.59.F04.1.454.CMB.1.raw
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttacaacgtaaaaggggnaggcccctaaggtcctcgtctctcgtgaaaccagactggaagtagcgtcccgtacgtagtcagtcgccacggtccgtaggtggtcgggccggtagtaccactcgtaccacctaattacgaccgtaccgtggccgctagaacgtctttcgtagtacctaactttacgtttcgtcgtacagtacgtaagttactacgtaacgttacgtccgttccccgttacgtttaccggttttacggaccggtaaccgggaacctaacggtaccgttacggaaaactaaccgtaaacgtacgttacggtcggtacgtacggaacctaccgtacttaccgtcgtttaccgttacttaccgttacccgttccccgtacctacgtttaccg

SEQ ID NO: 71587 - DNA, 548 bp, Homo sapiens
  misc_feature: GYAE6OF02F38ON.44.59.F04.1.454.CMB.1.raw
  modified_base (273)..(273): a, c, t, g, unknown or other
  misc_feature (273)..(273): n is a, c, g, or t
  modified_base (371)..(371): a, c, t, g, unknown or other
  misc_feature (371)..(371): n is a, c, g, or t
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (507)..(507): a, c, t, g, unknown or other
  misc_feature (507)..(507): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgtttcggtgctgttgcctggttcaacgaaaagggggnaggcccctaaggtcctcgtctctcgtgaaccagactggaaggtagacgtcccgtccaggttcagtgccagtccaggtggtgggccggagtccacgtcncaccattacgccgacctggccggcctggaagtatttcngactaactttactttcgtgtcagctagtatcatagtcnccccgtttnacttttcgggcctaggggacctaaggcctaggaaactcgaaacgacttggngcgtgccaccattcctgtccttcacttcctcccgctattcg

SEQ ID NO: 71588 - DNA, 584 bp, Homo sapiens
  misc_feature: GYAE6OF02I7J7W.44.59.F04.1.454.CMB.1.raw
  modified_base (284)..(284): a, c, t, g, unknown or other
  misc_feature (284)..(284): n is a, c, g, or t
  modified_base (319)..(319): a, c, t, g, unknown or other
  misc_feature (319)..(319): n is a, c, g, or t
  modified_base (430)..(430): a, c, t, g, unknown or other
  misc_feature (430)..(430): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcaccatcacttgccgggcgagtcgaggttccgttttcggtgcttggttgcccttggtttaccaaacgaaaaggggggnacggtcccctaaggtcctcgtctctcgtgaaaccngacgtggaagtagacgtcccgtcgagtcagtcgccagtccagggtggtcggggcccggtagtcccgtactccgtacaccgtattacggccgacctggccggtctagaagtnttctgactaacttatttctagtcagactagtactacagtacgtcgtacccgttctacgtttcgaccgtagggacctagtcgtagaaactcgaaacgacgtagtggacgtgaccacctatcttcgttacttcctagttccctccgtactcttacg

SEQ ID NO: 71589 - DNA, 583 bp, Homo sapiens
  misc_feature: GYAE6OF02FNY0S.44.59.F04.1.454.CMB.1.raw
  modified_base (270)..(270): a, c, t, g, unknown or other
  misc_feature (270)..(270): n is a, c, g, or t
  modified_base (350)..(350): a, c, t, g, unknown or other
  misc_feature (350)..(350): n is a, c, g, or t
  modified_base (394)..(394): a, c, t, g, unknown or other
  misc_feature (394)..(394): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggttcaacaaaaagggggngaggcccctaaggtcctcgtctctcgtgaaaccagactggaaggtagagtcccgtcaggttcagtgccagtccaggtggngggccggagtccactctcaccattagcgacctgcggcctgaagnttctgcaacttatttctgtcagcagtatcatagtcgtccccgttctacgttttcggcccgtaaggggaccctaaaggccttagggaaacttacgaaaacggtaacctaggtacgggactagccaacctaagttccttacgttacctttacctacttcccgttccccgtacctacttcctagtatttaac

SEQ ID NO: 71590 - DNA, 583 bp, Homo sapiens
  misc_feature: GYAE6OF02HO11R.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (403)..(403): a, c, t, g, unknown or other
  misc_feature (403)..(403): n is a, c, g, or t
tcagacagtatatacacgaccggtgctcgatttagtacacacacttaagggagttggggcatgagtcagaccctcgtcagggacagcatggacatggaggtcccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacgaaaaaggggngaggcccctaaggtcctcgtctctcgtgaaaccagactggaaggtagagtccgtccaggttcagtgccagtccaggtggtgggccgggagtccacgtctacactattacgcgacctgcgcctgaagtnttctgctaacttatttctgtcagctagtactcatacgtctccccgttctaccgttttggccgaaggggaccaaggtcgtagggaaaatacgaaacgtaacgtgttacgggcttacggcctaaaccgacttacgtacggttcctttactaaccttccctttacccccggcctaacgttccg

SEQ ID NO: 71591 - DNA, 644 bp, Homo sapiens
  misc_feature: GYAE6OF02IJA2D.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccggacgagtcaggttcgttttcggngctgtcgctggtttacaacgaaaaaggggnacggccctaaggtcctcgtctctcgtacgaaaccagacgtaggaagtagacgtcccgtctaggttcagtcgcctacgtccaggtggtcgggcgtaggacgtccacgtcctactaacctagttacgccgtaacctgaccggtctaggaacgtctttcgngacttaaactttntttccgtgtacagctaagtactacgtaagttacgtccgtacccgtttacgtaaccgttttcgggaaccgtacggggtaaccaacggttccgtaggtaacgtacttaaccgaaaaggtaccttgggtacggtaccgtagtaccctaacgtaacgttccgttacgttccgttaaccactttaccccgtaccccgtaaccg

SEQ ID NO: 71592 - DNA, 537 bp, Homo sapiens
  misc_feature: GYAE6OF02G2V0D.44.59.F04.1.454.CMB.1.raw
  modified_base (271)..(271): a, c, t, g, unknown or other
  misc_feature (271)..(271): n is a, c, g, or t
  modified_base (456)..(456): a, c, t, g, unknown or other
  misc_feature (456)..(456): n is a, c, g, or t
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
  modified_base (532)..(532): a, c, t, g, unknown or other
  misc_feature (532)..(532): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggngacggcccctaaggtcctcgtctctcgtagaaaccagactggaaggtacgagtcccgtcaggttcagtcgccagtccagggtggtcgggccggagtccactctcaccattacgcgaccctggcggcctagaacgtacttctgctaactttatttctagtcagctagtatctatagtcgtcccttntactttcggcctaggggaccagctaggaatacaaacgatgngctgctacntctcgtctcacttctcccgctatctntatac

SEQ ID NO: 71593 - DNA, 636 bp, Homo sapiens
  misc_feature: GYAE6OF02FV4UK.44.59.F04.1.454.CMB.1.raw
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgttttcggngctgttgcctggtttcaacgaaaaggggngacggcccctaaggtcctcgtctctcgtagaaaccagacgtggaaggtagacgtcccgtcgaggttcagtgccagtccgaggtgagtgggccggagtccactctacaccattacgcgtacctggccggtcctaggaacgtatttcgtacggtactaaactttactttcgtgtctaagctaagttacttcaagttagtcccgtaccccgtttctaacggttttcggacccgtaacgggggaacctaaggtcctaagggaaacttaccgaaacgtaccgttggtacgggtaccgtacggaccctaacccgtattcccgttagttccctttaccgtacctttccccgttaccccggaccttaacg

SEQ ID NO: 71594 - DNA, 541 bp, Homo sapiens
  misc_feature: GYAE6OF02GHUJA.44.59.F04.1.454.CMB.1.raw
  modified_base (275)..(275): a, c, t, g, unknown or other
  misc_feature (275)..(275): n is a, c, g, or t
  modified_base (365)..(365): a, c, t, g, unknown or other
  misc_feature (365)..(365): n is a, c, g, or t
  modified_base (415)..(415): a, c, t, g, unknown or other
  misc_feature (415)..(415): n is a, c, g, or t
tcagacagtatatacacgaccggtgctcgatttagtacacacacttagggattgggggcatgagtcagaccctgtcaggggacagcatggacatgagggtccccgatcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggngaggcccctaaggtcctcggtctctcgtgaaaccagactggaaggtagagtcccgtccaggttcagtgccagtccaggtggtgggccggngtccatctcacattagccgtacctgcggcctgaagacttctgctaacttntttctgtcagcagtatcatacgtcgtcccgttctacgttttcggccgtaggggtaccaagtcgtaggaaactacgaaacgactgtggctgcctacatctgttcttactccttcccgctactctacg

SEQ ID NO: 71595 - DNA, 570 bp, Homo sapiens
  misc_feature: GYAE6OF02FKXH0.44.59.F04.1.454.CMB.1.raw
  modified_base (279)..(279): a, c, t, g, unknown or other
  misc_feature (279)..(279): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (406)..(406): a, c, t, g, unknown or other
  misc_feature (406)..(406): n is a, c, g, or t
  modified_base (448)..(448): a, c, t, g, unknown or other
  misc_feature (448)..(448): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgctgttgccttggtttacaacgaaaaagggggngacggcccctaaggtcctcgtctctcgtgaaaccngactggaagtagagtcccgtcaggttcagtcgccagtccaggtggtcgggcggngtccactcncacattacgcgacctgcgctgaagattcngactacttattctgtcagtcagtatcatagtcgtccccgttntacgttttcggccgtacggggacctaagtcgtaacggaaactaccgaaacgtacgttgtacggtacgtacgaccaacctagttcctagttaccttcgtacttccgttaccccgcctattccg

SEQ ID NO: 71596 - DNA, 602 bp, Homo sapiens
  misc_feature: GYAE6OF02H6MWY.44.59.F04.1.454.CMB.1.raw
  modified_base (441)..(441): a, c, t, g, unknown or other
  misc_feature (441)..(441): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttggccgggcgagtcaggttcgttttcggtgctgttgccttggtttacaaacgaaaaaggggagacggccccgtaaggtcctcgtctctcgtagaaaccagactggaaggtacgacgtcccgtcgaggttcagtcgccgtagtccgaggtgggtgggccggagtccacgtctcacctagttacgccgacctggcggtcctaggaacgtcttctgaccttaatttntttcgtgtccagcaaggttacacgtattacgtccgtcccccgtttacgtaccgtttttacgggacccgtaagggggtaccctaaggtccgtaaggaaactcgaaacgtacgtggtagtcgtgccacctagttcctgtcttcgacttcccgtcccgctatcg

SEQ ID NO: 71597 - DNA, 773 bp, Homo sapiens
  misc_feature: GYAE6OF02JARTP.44.59.F04.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
  modified_base (345)..(345): a, c, t, g, unknown or other
  misc_feature (345)..(345): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgaccagtctccttcctctgtcttcttctgttgagcagcgtcaccatcacttgccgggcgagtcaggttcgttttcggngtctgttcgccttaggttcaaacgaaaaggggngacggtccctaaggtcctcgtctcgtcgtagaaaccngacgtggaagtacgacgtcccgtacgtacggttnacgtcgcctagtccgaaggtcgggtcggggaccggtacgtcccgtacgtccgtacaaccgtacgtttagacccggtaccgtcgggtaccgggcccttaaggaaacgtactttcgtacggtaccttaaaccgttttatttccgttacgtaccgtacgtacgtaaggtttaaccttaccgaacgttaacggtcccgttaccccggttttattaacccggttttttccgggaacccggttaacggggggaacccttaaacggggttacccgttaaacgggttaaaaccgttacccgtaaaaaacggttaccggtttacgggttaacgggtaccccgtttacggaacccgtaacccgttaacggtttacccgttcgtttaacccgttccgtaaccgttttaccccgtcccccggtaacgttaccgttaccgg

SEQ ID NO: 71598 - DNA, 603 bp, Homo sapiens
  misc_feature: GYAE6OF02HX2EQ.44.59.F04.1.454.CMB.1.raw
  modified_base (278)..(278): a, c, t, g, unknown or other
  misc_feature (278)..(278): n is a, c, g, or t
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgtttcggtgctgttgccttggtttcaacgtaaaaagggggngacggcccctaaggtcctcgtctctcgtgaaccagactggaagtagagtcccgtcaggttcagtgcagtccaggtggtgggcgagtccactctcaccatagcgactgcgctgagatctgctaattattctgtcagcagttancattagctcccgttnaccgttttgccgtagggggaccctaaggcgttacggaaaactaccgtaaaacgaaccgttaggtacggtaccgttggacccgtaacccgtaacgtttcccgttaagggtttcccgtttaccgttaaccctttccccggttttaaccccggtccccttaactttcccgg

SEQ ID NO: 71599 - DNA, 699 bp, Homo sapiens
  misc_feature: GYAE6OF02GG8HN.44.59.F04.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
tcagacagtatatacacgaccggtgctcgatttagtacacacacttagggattggggagcttcagctgtggtagagaagacaggattcaggacaatctccagcatggccggcttccctctcctcctcaccctcctcactcactgtgcagggtcctgggcccagtctgtgctgactcagccatcctcagcgtctcgggacccccggnagacggtcacgtntcttttgtctggagtaggtccaanatcggaataattacgtatactggtatcggctaattcacaggagccggtaccccagacccctnatctagtaggganaatcgaggccggccctgacggggtcctgaccgtattcgtctcgccttccaagtctaggccacctcgacgtccctcccgtcgggcctatccgtacggtcgggacccgttcccgggtaccggacgggtacgttacgggaacgggtccgttacggttaactttacgttttcccgtagggttcgggtacccggttccggtttaggggacgttacgggactacgtttcccggttaggacggttcgggtaacctcgggttaccgttacgggttccggggaccgggtaacggggaaccctaagggtccgttaccgggaaccccgtttcgtaaacgtcccgacggtaacccccggtaaggtcccgtacccgggtccccccgttaccggg

SEQ ID NO: 71600 - DNA, 576 bp, Homo sapiens
  misc_feature: GYAE6OF02HDHDV.44.59.F04.1.454.CMB.1.raw
  modified_base (274)..(274): a, c, t, g, unknown or other
  misc_feature (274)..(274): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaggggngaggcccctaaggtcctcgtctctcgtgaaaccagactggaaggtagacgtcccgtcaggttcagtgccagtccaggtggtgggcggacgtccactctcacctattacgccgtaccgtgcggtcctggaagtattctcgactaactttatttctgtcagctagtatcagtacgtcgtcccgttctaccttttcggccgtaacggggacctaaacgtcgtaacggaaactaccgaaacgtacgtcgtcggtcgtcggacctacctattcttcgttcttcctacttccttacccgtcctagttc

SEQ ID NO: 71601 - DNA, 711 bp, Homo sapiens
  misc_feature: GYAE6OF02IWUZ9.44.59.F04.1.454.CMB.1.raw
  modified_base (282)..(282): a, c, t, g, unknown or other
  misc_feature (282)..(282): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcgagtcaggttcgttttcggtgcttgttcgccttggtttccaaaacgaaaaagggggnacggacccctaaggtcctcgtctctcgtagaaaccagactgggaaggtagacgtcccgtcaggttcagtcgccagtccgaggtggtgggccggagtccactctcaacctattacgcgtaacctggaccggtcctaggaaacgtatttcgtagaccttaaacgtttactttctcggttaccaaggtactacggtttaaacttccgtaaagtttaccggttccgtacccccggttttaattacccggttttttacgggtacccggtaacgggggaacccggtaaaccggtacggttaaccggtaaaacgttaaaccgtaaaaacccggtaaacgttcggttacgggtaccgtacggtaaccgaacctaacgttacgtttacgtaccgttttctaaccgtttcccggtttaccccgtcccgtatttacccgg

SEQ ID NO: 71602 - DNA, 584 bp, Homo sapiens
  misc_feature: GYAE6OF02IXRQT.44.59.F04.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
  modified_base (541)..(541): a, c, t, g, unknown or other
  misc_feature (541)..(541): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtcctccttccttctgttcttcttctgttggagcagctnaccatcacttgccgggcgagtcaggtcgttttcggngctgttgcctggtttacaacgtaaaagggggacaggcccctaagggtccctacgtctctcgtagaaaccagactgggaagtagagtcccgtcgagttcagtcgcctagtccgaggtcggtgggccggacgtccacgtctcactattagcgacctgcggctagagacttcngctaacttacttctagtcagtcagtactctatacgtcgtccctttnaccgttttcggacccgtaacgggaccaagtcgtaacggtaaataccgaaacgaacttaggacggtcgttagacctaactnttaccgttgtacctttcacttccgttccccgtacctacttacg

SEQ ID NO: 71603 - DNA, 593 bp, Homo sapiens
  misc_feature: GYAE6OF02HXODY.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttcctctgtcttcttctgttggaggcagcgtcaccatcacttgccgggcgagtcaggttcggttttcggtgtcttgttcgccttggtttaccaacgaaaaagggggagaggcccccgtaaaggtcctcggttctctcgtgaaaccagactggaaggtacgagtcccgtcaggttcagtgccagtccaggtgtgggcggagtccacgtctcacattagccgtactgccggctgaagattctgactaacttatttccgtgtcagtacagttactcaattgtccgtaccccgtttcgtacgttttcggccgtaacggggacctaagccttaaggaaactcgaaaacgtacctaggtcgtagtcgacctaccgacttacgtagttccttaccgacttacccgtcccgtacccgatttacccg

SEQ ID NO: 71604 - DNA, 581 bp, Homo sapiens
  misc_feature: GYAE6OF02FSFCJ.44.59.F04.1.454.CMB.1.raw
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (396)..(396): a, c, t, g, unknown or other
  misc_feature (396)..(396): n is a, c, g, or t
  modified_base (443)..(443): a, c, t, g, unknown or other
  misc_feature (443)..(443): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaagggggagaggcccctaaggtcctcgtctctcgtnaaaccngactggaaggtagagtcccgtcaggttcagtgccagtccaggtggtgggccggagtccactctcaccattagcgacctgcggctganatctgcaacttatttctgtcagctagtatcatagtcgtccccgtttntaccgttttcggccgaaggggtaccctaaggtccgtaaggtaaactaccgaaaacgtaacctagggtacggtcgtacgaccaacccacttccgttagttcctttaccgtacttcccgtttaccccgtcctagttcccg

SEQ ID NO: 71605 - DNA, 704 bp, Homo sapiens
  misc_feature: GYAE6OF02JJGZP.44.59.F04.1.454.CMB.1.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
tcagacagtatatacacgaccggtgctcgatttagtacacacacttagggattggggggcactgacgtcgagaccctgtcaggggtacagcatggacatgagggtccccgctcagctcctggggctcctgctgctctggctcccaggttcgagatgtgactatcgagatgaccagtctccttcttcctgtcttcttcgtgttggaggcagcgtcgaccatcacttgccgggcaggtcagggttcgttttcggngtcttgttcgcccttaggttttccaaacgtaaaaagggggngacggcccctaaggtcctcgtctcgtcgtacgaaaccgngactgggaaggtagacgtcccgtacgaggttcaggtgccagtccgaggtcggtggggccggagtccgacttcgtcgaccgtagttacgccgtacctcggacggtccctaggaaacgtacttccgtacggacctaaaacgttttctttcgttacggttactaacggcctaaggttaacttacgtaagttacggtccgacccccgttttataaccggtttttccgggaccgtaacgggggtaacctaacgggttccttaagggtaaaaccttacggaaaccgtaccgttggtacggccgttaaggacctaccgtaagttccgttagttacccgtttacgaaccgtttcccgttaccccgtaccgtaattccgg

SEQ ID NO: 71606 - DNA, 576 bp, Homo sapiens
  misc_feature: GYAE6OF02GAM47.44.59.F04.1.454.CMB.1.raw
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (411)..(411): a, c, t, g, unknown or other
  misc_feature (411)..(411): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaacgaaaaggggngacggcccctaaggtcctcgtctctcgtagaaccagacgtggaaggtagacgtcccgtcgaggttcagtcgccagtccgaggtggtgggccggacgtccactctcacctattacgcgacctgcggcctagaacgtnttcgtgactaacttatttctgtcagctagtatacattacgtcgtcccgttctactttcggccgacggggaccaaggtcgtaaggtaaactacgaaacgtacgtggtacgtacgtcgacacctgttccttagttccttactacttcccgttccccgtactattacg

SEQ ID NO: 71607 - DNA, 566 bp, Homo sapiens
  misc_feature: GYAE6OF02GIGUB.44.59.F04.1.454.CMB.1.raw
  modified_base (246)..(246): a, c, t, g, unknown or other
  misc_feature (246)..(246): n is a, c, g, or t
  modified_base (277)..(277): a, c, t, g, unknown or other
  misc_feature (277)..(277): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttacaacgaaaaaggggnacggcccctaaggtcctcgtctctcgtagaaaccagacgtaggaaggtagacgtcccgtcaggttcagtcgccagtccgaggtggtcgggccggagtccacgtctccacctattacgcgtacctggcggctagaacgtnttctgctaacttntttctgtcagtctagtntactatacgtcgtcccgttctacgttttcggaccgtacggggtaccaagtctaggaaactacgaaacgtactgtcggactgaccacctagtctcgtacttctacttccgtcccactattc

SEQ ID NO: 71608 - DNA, 691 bp, Homo sapiens
  misc_feature: GYAE6OF02I2V3B.44.59.F04.1.454.CMB.1.raw
  modified_base (247)..(247): a, c, t, g, unknown or other
  misc_feature (247)..(247): n is a, c, g, or t
  modified_base (519)..(519): a, c, t, g, unknown or other
  misc_feature (519)..(519): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtcctccttccttcctgtcttcttctgttggagcagcgtcaccatcacttgccgggcgagtcgaggttcgttttcggngtctgttgccttggtttacaaacgaaaagggggagacggacccctaaggtcctcgtctctcgtagaaccagactaggaaggtagacgtcccgtcaggttcagtgaccagtccgaggttcggtggggccggtagtcccacttcgtacacctagttacgccggtaaccctcggccgggtacctaggaaacgtactttcgtcggaccttaaacgtttattttccgtagttaccaaggtactaagttactactaagttacgtcgtacccccgtttntaccgtttttacgggacccgtaacgggggaaccctaaggtccgttacggaaaaacttccgaaaaacgtaccgttagggtacgggttacacgggttaccaaccgtaactttcccgttaacggtttacctttaccgaaccttttcccggttacccccgtacctaacgtttcccg

SEQ ID NO: 71609 - DNA, 674 bp, Homo sapiens
  misc_feature: GYAE6OF02ID94M.44.59.F04.1.454.CMB.1.raw
  modified_base (169)..(169): a, c, t, g, unknown or other
  misc_feature (169)..(169): n is a, c, g, or t
  modified_base (240)..(240): a, c, t, g, unknown or other
  misc_feature (240)..(240): n is a, c, g, or t
  modified_base (270)..(270): a, c, t, g, unknown or other
  misc_feature (270)..(270): n is a, c, g, or t
tcagacagtatatacacgaccggtgctcgatttagtacacacacttagggattgggggcatgagtcagaccctgtcaggggacagcatggacatgagggtccccgctcagctcccggggctcctgctgctctggctcccaggttcgagatgtgacatcgagatgacccngtctccttcctctgtcttcttctgtggagcagcgtcaccatcacttgcgggcagtcaggttcgttttcggngctgttgccttgttacaaagaaaagggggnacggaccccgtaaggtcctcgtctcgtcgtagaaaaccaggtacgtagggaaaggtacgtaaccgtcccgtaccgtaggttcaacgtcgacctaagtccgaagggtggtcggggaccggtacgtccacgtccacgactagttacgacgaccgtggccggccgtaggtaaagtactttccgtacgtaccgtaacttttactttcgtcggttacagctaagttactacgtacgttaacgtccgtaccccgtttacttaaccgttttcgggaccgtaacgggaacccgaacgtcggttaaggaaaactacgtaaaacgtaacgttcggtacggtcgtaccgacctacccgtaattccgttcgttacccttacgtaccttcccgtttccccgacttacgtccttaacg

SEQ ID NO: 71610 - DNA, 699 bp, Homo sapiens
  misc_feature: GYAE6OF02JEU5Z.44.59.F04.1.454.CMB.1.raw
  modified_base (246)..(246): a, c, t, g, unknown or other
  misc_feature (246)..(246): n is a, c, g, or t
  modified_base (276)..(276): a, c, t, g, unknown or other
  misc_feature (276)..(276): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggngctgttgcctggtttcaaacgaaaaggggnacggcccctaaggtcctcgtctcgtcgtacgaaccagactggaagtagacgtcccgtcaggttcagtcgcagtccgaggtgggtcgggccggtagtcccactctcacctattacggccgtaccgtggccggtacctaggaacgtactttcgtacggaccttaacttttatttccgttaggttaccagtctaagttacttccgtaagttacggttcccggtcccccgttttattaacccggtttttcgggacccggtaaacggggggtaccctaaagggtcccttaaggggtaaaaccttaaccgtaaaaccggtaaccgtttggtacgggtaccgttcggaaccctaacccgttacttaccgtttaccggttccttttaccgtaccgttttcccccgttaccccggtaccctaagtttcccgg

SEQ ID NO: 71611 - DNA, 703 bp, Homo sapiens
  misc_feature: GYAE6OF02GWN1C.44.59.F04.1.454.CMB.1.raw
  modified_base (272)..(272): a, c, t, g, unknown or other
  misc_feature (272)..(272): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggngacggcccctaaggtcctcgtctctcgtgaaaccagactggaaggtagacgtcccgtccaggttcagtcgccagtccgagggtggtcggggccggagtcccactctcacctattacggccgtacctggccggcctggaaagtattcgtcgacctaaagttttatttctgtcacggtctaagttatactattacggtccgtaccccgtttactaccgtttttcgggacccgtaagggggtaaccctaagggtcccgttaagggaaaacctttaccgaaaaaccgggtaacctttaggggaccggtaccttacgggtaccctaacccggtaaactttcccgttacggtttacccttttacccgtaaacgttttcccccggttttaccccccgacccgtttaacgtttacccgtttacgggtaacttttaaacg

SEQ ID NO: 71612 - DNA, 611 bp, Homo sapiens
  misc_feature: GYAE6OF02HT800.44.59.F04.1.454.CMB.1.raw
  modified_base (276)..(276): a, c, t, g, unknown or other
  misc_feature (276)..(276): n is a, c, g, or t
  modified_base (566)..(566): a, c, t, g, unknown or other
  misc_feature (566)..(566): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagctcacatcacttgccgggcgagtcaggttcgttttcggtgctgttcgccttggtttacaacgaaaaaggggngacggccccgtaaggtcctcgtctctcgtagaaccagactggaagtagacgtcccgtccgaggttcagtcgaccgagtaccgagggtcggtcgggccggtacgtcccacgtctaccaacctattacggaccgtacctggccggtctaggaagtactttctcggacctaaactttatttctcgtccagtcctagttactctacttacgtccgcccctttattaccggttttcggccgacggggtacccaagtcgttagaaaactcgaaaacgtctaggttgaccgtgaccnctaagttctcgttcttactaccttaccccgtcccgtacacttacg

SEQ ID NO: 71613 - DNA, 540 bp, Homo sapiens
  misc_feature: GYAE6OF02G2ORT.44.59.F04.1.454.CMB.1.raw
  modified_base (241)..(241): a, c, t, g, unknown or other
  misc_feature (241)..(241): n is a, c, g, or t
  modified_base (274)..(274): a, c, t, g, unknown or other
  misc_feature (274)..(274): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (453)..(453): a, c, t, g, unknown or other
  misc_feature (453)..(453): n is a, c, g, or t
  modified_base (508)..(508): a, c, t, g, unknown or other
  misc_feature (508)..(508): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgccttggtttcaaacgaaaaagggggngacggcccctaaggtcctcgtctctcgtgaaaccagactggaaggtagacgtcccgtcaggttcagtcgccagtccaggtggtgggccggagtccactctcaccattacgcgacctgccggcctgaagtnttcngctaactttatttctgtcagctagtatcatacgtcgtccccgttntacgttttcggccgagggaccaagctaggaaactcaaacgtactgtgctgcaccntctgtcttcattccttcccgctatctagtata

SEQ ID NO: 71614 - DNA, 589 bp, Homo sapiens
  misc_feature: GYAE6OF02F7OJ5.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaaacgaaaaggggngaggcccctaaggtcctcgtctctcgtagaaaccagactggaaggtagagtcccgtcaggttcagtgccagtccaggtggtgggccggagtccactctcaccattgccgtacctgcgcatgaagattctgctaacttatttctgtcagtcagtatcatacgtcgtacccgttctaccgttttcggacccgtacggggaacctaaggtccgtaagggaaactaccgtaaaacggtaccttggtacggtcctcggaccaacccgttattccgttcgttacctttaccacgtttcccgttaccccgtaccttaaccg

SEQ ID NO: 71615 - DNA, 745 bp, Homo sapiens
  misc_feature: GYAE6OF02IJIKM.44.59.F04.1.454.CMB.1.raw
  modified_base (162)..(162): a, c, t, g, unknown or other
  misc_feature (162)..(162): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagntcgacccagtctccttccttctgtcttcttctggttggagcagcgtcaccatcacttcggccgggcgagtcaggtttcgttttcggngtcttgttcgtccgttaggtttacaaacggaaaagggggngacggcccttaaggtcctacgtcctctacgtacgaaaccgagtacgtaggaagtagacgtcccgtcgtaaggttcagtcgcctagtccgtagggttcgggtcggggaccggtacggtccctaacgttccgtacctaaccgtaagtttaacggcccgtaacccgttcgggccggtaccgttaggaaacgttacctttaccggacgtaacctttaacgtttttaacgttttccgtacggttaccgtacgtaccgttaagttaaccgtacttaaggttacccggttaccggtaccccccgttttagtttaccggtttttaccggggcccgtaaaccggggggtaacctaacggtacgttaaacgggtaaacttaaacccgtaaacgtacggtttcggcggttaccgtagaccctacgtacgtcgttacgttctactaccgttccttacccgactagttc

SEQ ID NO: 71616 - DNA, 559 bp, Homo sapiens
  misc_feature: GYAE6OF02HRAOI.44.59.F04.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
  modified_base (359)..(359): a, c, t, g, unknown or other
  misc_feature (359)..(359): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (454)..(454): a, c, t, g, unknown or other
  misc_feature (454)..(454): n is a, c, g, or t
tcagacagtatatacacgaccggtgctcgatttagtacacacacttagggattgggggcatgagtcagaccctgtcaggggacagcatggacatgagggtccccgctcagctcccggggctcctgctgctctggctcccaggttcgagatgtgacatcgagatgacccagtctccttccttcctgtcttcttctgttggaggcagcgtcaccatcacttgccgggngagtcaggttcgttttcggngctgttgccttggtttacaacgaaaaagggggnacggcccctaaggtcctcgtctctcgtgaaaccagactggaaggtagacgtccgtcaggttcagtgccagtccaggtggngggccgagtccactctcacagttagcgacctgcggcctagaagtnttcngactaactttatttcngtcagcagttatcattacgtcgtcccgttntacgttttcggaccgtaggggaccaacgtcgtacgaaactacgaaaggtactgtggactggcacctatcgttgtaccttctacttccgttcccgactagtctacg

SEQ ID NO: 71617 - DNA, 854 bp, Homo sapiens
  misc_feature: GYAE6OF02IGHSS.44.59.F04.1.454.CMB.1.raw
  modified_base (244)..(244): a, c, t, g, unknown or other
  misc_feature (244)..(244): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcacatcacttgccgggcagtcaggttcgttttcggngcttgttcgccttggtttacaaacgtaaaaaagggggcgacggaccccgtaaggtccctacgtctcgtacgttacgaaaaccaggtaacgtagggtaaacggtacggaccgttcccccggttacgtaaggtttccgaaggtccggtaccgtacgttacccggaaggggttcggggttccgggggaccccgggtaacgttccccgtaaacgttcccgttaacccgaacccgttaacgtttaaccggacccggtaaccccgttcgggaccccgggttacccgttaacggtaaacggtaacttttaccgttacggtaaccctttaaaacctttttaacgttttaccgttacggttaccgtaacggtacccgttaaaggttacttaccgttaacgttacggttaccgttacccccggttttacgttaacccggttttttacgggacccggttaacgggggtaacccgtaaacggtaccgttaacgggtaaaacgttaacccgtaaaaacggtaccgttacgggtacggtaccgttaccggaccctaaccgtaccgttccgttacgtttaccttaccgtaacgtttccccgttaccccggtacctacgttacccg

SEQ ID NO: 71618 - DNA, 639 bp, Homo sapiens
  misc_feature: GYAE6OF02HHJJK.44.59.F04.1.454.CMB.1.raw
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtctccttccttctgtcttcttctgttggaggcagcgtcacatcacttgccgggacagtcaggttcgtttcggngctgtgccttggttacaacgaaaaggggnacggtccctaaggtcctcgtctctcggtacgaaaccagacgtaggaaggtagacggtcccgtcagggtttcagtcgaccagtccagggtgcgggcgtacgtccacgtctcactagttacgcaccgttggccgtcgtgaagtactttcgtacggtactaactttatttcgtcgttacgtacgtacgtaagttactactagttacgtccggtcccgtttaccgtacgttttcgggaccggttaacggggacctaacgtacgtaacggtaaactaaccgtaaacgtaacgttcgggagtccgttacgcctaacctaacgtccgttagttcccgttctaccgttcccgtttacccgtacctactttaccg

SEQ ID NO: 71619 - DNA, 518 bp, Homo sapiens
  misc_feature: GYAE6OF02HQP2Y.44.59.F04.1.454.CMB.1.raw
  modified_base (245)..(245): a, c, t, g, unknown or other
  misc_feature (245)..(245): n is a, c, g, or t
  modified_base (275)..(275): a, c, t, g, unknown or other
  misc_feature (275)..(275): n is a, c, g, or t
  modified_base (372)..(372): a, c, t, g, unknown or other
  misc_feature (372)..(372): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggngaggcccctaaggtcctcgtctctcgtgaaaccagactggaaggtagagtcccgtccaggttcagtgccagtccaggtggtgggccgagtccactcncaccattagcgacctgcggcctgaagattctgcaacttattctgtcagtcagtatcatagtgccccgtttcaccttttggaccctaggggaccaaggctaggaaatcaaacgactgtgctgcaccatcngtcttcntctccgcatc

SEQ ID NO: 71620 - DNA, 634 bp, Homo sapiens
  misc_feature: GYAE6OF02GN06S.44.59.F04.1.454.CMB.1.raw
  modified_base (279)..(279): a, c, t, g, unknown or other
  misc_feature (279)..(279): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggttcgttttcggtgcttgttgccttggtttacaacgaaaaaggggngacggcccctaaggtcctcgtctctcgtgaaaccagactggaaggtagacgtcccgtctaaggttcagtcgccacgtccgaggtggtgggcccggagtccactctcaccaattacgccgacgtcgcggcctagagtattctgactaacttactttctgtcagctagtatctagtacgtcgtccccgttataccgttttacggacccgtacgggggtaacccaaggtccgtacggtaaaacgttaaccaaaccggtaacgttggtacggtaccttacgggaccctaacccgtaagttcccgttagtttaccctttacgtaccgttacccgttttacccccgacccgtacttacccg

SEQ ID NO: 71621 - DNA, 635 bp, Homo sapiens
  misc_feature: GYAE6OF02I2C77.44.59.F04.1.454.CMB.1.raw
  modified_base (162)..(162): a, c, t, g, unknown or other
  misc_feature (162)..(162): n is a, c, g, or t
  modified_base (249)..(249): a, c, t, g, unknown or other
  misc_feature (249)..(249): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (312)..(312): a, c, t, g, unknown or other
  misc_feature (312)..(312): n is a, c, g, or t
tcagacagtatatacacgaccggtgctcgatttagtacacacacttagggattgggggcatgagttcagaccctgtctagggacagcatggacatgaggtcccgctcagctcctggggctcctgctgctcgtggctccgaggttcgagatgtgacatcgagntcgacccagtactccgttacctctgtcttcttcgtgttcggagcagtcgtcaccgatcacttggccgggcagtcacggtctttcggnctagttgctggttacaaacgtaaaaggggnacgccctaaggtcctacgtctctcgtanaaccngacgtggaagtcgacgtcccgtacaggttcagtgaccagtccgaggtggcggcgagtccacgtcacacgtattacgcgtactgccgtactgaagtactttcgagacttaacttacttctagttacagtcgaagttactctaatcggtctccccggtttctaacgttttcggaccgtaacggggtaccctaacgggtccttaacgggaaacctaccgtaaaaccgtaccgttcgggtacgtcccgttacggaccctacccgtaagttccgttccggttacttaccgtaccgttaccccggtttccccgacgttaccgttaccgg

SEQ ID NO: 71622 - DNA, 689 bp, Homo sapiens
  misc_feature: GYAE6OF02JLURC.44.59.F04.1.454.CMB.1.raw
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagctcacatcacttgccggcagtcaggttcgttttcggngtcttgttcgccttggttacaaacggaaaaggggngacggcccctaaggtcctcgtctctcgtagaaaccngtaccgtggtaaggtacgtacggtcccgtacgtacggtttcacggttcggacctacggtccgagggttggggtcgggggaccggtacgtcctactccgtaccaccgtaagttcggaccgtacctcgggccgacctaggaacgtctttcgtacgaccttaactttactttctcggttactaggcctaagtttactacgtacttacggtcccgttccccggtttattaccggttttaccgggacccggtaaacgggggttacccaaggtcccgttaaggtaaacctacggtaaaccgtacggtcggtacggtcgtaccgactaacctacgttccgttcgttaccttactaccggtttcccgtacccgtacctagttccc

SEQ ID NO: 71623 - DNA, 674 bp, Homo sapiens
  misc_feature: GYAE6OF02F5NMK.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcaccatcacttgccgggcgagtcaggttcgttttcggtgcttgttcgccgttggtttacgaaacggaaaaagggggacgacggtaccccgtaaggtcctcggttctctcggtacgaaaccagacgtaggaaggtagacgttcccgccgtaggttcgagtcgcctacgtccgtaggtgggtcggggaccggtacgtccacttctacacctagtttacgccgaccgtcggcggcctaggaacgtactttcgtacgtaccttaaacgttttactttcgttagtccgacggtacctagttactacgtaagttacggtcctccccgtttacttacggttttcgggcccggtaacggggacctaaggtccgttaaaggaaacttaaccgaaaaccggtacgtcgtacggccttacggacctaaccgtcttcgtgtttacctcttacgttccccttcccggtacctacgttacg

SEQ ID NO: 71624 - DNA, 641 bp, Homo sapiens
  misc_feature: GYAE6OF02IFRWS.44.59.F04.1.454.CMB.1.raw
  modified_base (169)..(169): a, c, t, g, unknown or other
  misc_feature (169)..(169): n is a, c, g, or t
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcagatgtgacatcgagatcgacccngtctccttcctcctgtcttcttctgtggagcagcgtcacatctacttgccgggcgagtctagggttcgttttggncttgtgtctggttacaaaggaaaagggggnacggtaccctaaggtcctcgtctctacgtagaaaccngactaggaagtacgcgtcccgtaccgaggttcagtcgaccagtcgaggtggtcgggccggatccactctacactagtacgccgtaccgtggccgacgtagaacgtacgttcgtacgtacttaaccttagtttacgtcgtacgtagtactaacgtactacacgttacgtcggtaccccgtttagttaccgtttacggccggaacgggtaaccaaggtcgttaacggtaaaactaaccgtaaacgtaacgttggacggtaccgtaggaccctaccgtaacgttcgtacggtttccttaccgtaccttacccgttccccgtacctagttaccg

SEQ ID NO: 71625 - DNA, 630 bp, Homo sapiens
  misc_feature: GYAE6OF02IEDS0.44.59.F04.1.454.CMB.1.raw
  modified_base (244)..(244): a, c, t, g, unknown or other
  misc_feature (244)..(244): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttctgtcttcttctgttggaggcagcgtcaccatcacttgccgggcagtcaggttcgttttcggngcttgttcgccttggtttacaaacgtaaaaagggggcacggcccctaaggtcctacgtcctcctcgtacgaaacctagacgtagggaacggtagacgtccccgtcaaggttcagtcgcctacgtcgaggtggtcgggccggtagtccactcctacaccaattcgccgtacctggccggtcctaggaacgtacttcgtacgaccttaactttagtttccgtaggttaccagtcctaagttactactaacgttacgttccggtaccccgtttacgtaccgtttttcgggacccgtaacggggacctaacggtcgtaaggaaactacgtaaacgtacgtcgtcggctgacctctaagtcttacgtctactacttccctccgcctagtcg

SEQ ID NO: 71626 - DNA, 762 bp, Homo sapiens
  misc_feature: GYAE6OF02H58DC.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctccgaggttcgagatgtgacatcgagatcgaccagtctccttcctctgtcttctctgttggagcagctcacatcacttgccgggcgagtcgtaggttcgttttcggtgtcgttgttcgtccgttaggtttaaccgaaaacggtaaaaaggggggcgaccgggtacccccgttaagggttcccttacggttacctccgtccggtaacgaaaacccgacgtaaccgtagggtaacggtacgtaccggttccccgtaccgtagggttccgaggtcgaccgtacgtccggagggttcggggtcggggaccggtacgtcctaccgtccgtacaacccgtacgttacggcccggtaccgtcgggcccggtaccgtaggtaacgtacgtttccgacgtacccttaaacgtttactttcgttacggtcgtacgtccgttaagttactacgtaagttacggtccgtacccccgtttgttaaccggttttcgggacccgtacggggtaacctaacggtacgttaacgggtaaaactacccgtaaaaccgtacgttaggtaccggtcgtacgtaccgtaaccgtagtttcgtacgttccttaaccgtccgtttccccgtacccgcccttaacgttccg

SEQ ID NO: 71627 - DNA, 710 bp, Homo sapiens
  misc_feature: GYAE6OF02F2U2V.44.59.F04.1.454.CMB.1.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (319)..(319): a, c, t, g, unknown or other
  misc_feature (319)..(319): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccgtcctcactgtctgcgtctattggggacagagtcaccatcacttgccgggcgagtcgaggtcgttttcggngctgttgccttggtttacaaacgaaaaagggggngacggcccctaagggtccctcgtctctcgtagaaaaccnggaccgtggaaggtagacgtcccgtcaggttcagtcgaccagtccagggttcggtgggccggagtcccaacgtctaccaccgtagttacggccgtaaccgtcgcccggtccttagggaaacgtacgttccgtacgtaccgttaaacgttttactttaccgttcgtaccgtaagtaccgtaagtttactctaagttacggttccgtcccccggtttagtacgtttttcgggaacccgtaagggggtaaccctaaggtccgtaagggtaaaccttaaccgtaaaaccgtaccgttaggtacgggtaccttaacggaccctaacccgtagtttacccggttacggttaccctttaccgtaccgttttaccccgttacccccgacctttaaaccg

SEQ ID NO: 71628 - DNA, 600 bp, Homo sapiens
  misc_feature: GYAE6OF02G789L.44.59.F04.1.454.CMB.1.raw
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (338)..(338): a, c, t, g, unknown or other
  misc_feature (338)..(338): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcagtcaggttcgtttcggngctgttgcctggtttcaacgaaagggggnacggcccctaaggtcctcgtctctcgtgaaccngactggaagtagacgtcccgtcaggttcagtnccgagtccaggtggcgggccgagtccactcacactattacgcgacctgccggcctagaagtcttcgtcgactaactttctttctcgtcgtacgctaagtctacgtacgttacgtcggtccccgtttctaccgttttacggaccggtaacggggaccgtaacgtcgtaaggaaactacgtaaaccgtacgtacgtcggtacgtcgacctaccgtacttccgttgttactttacgtaccttcccgttacccgtcctacgttacg

SEQ ID NO: 71629 - DNA, 615 bp, Homo sapiens
  misc_feature: GYAE6OF02H143G.44.59.F04.1.454.CMB.1.raw
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
  modified_base (277)..(277): a, c, t, g, unknown or other
  misc_feature (277)..(277): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttctcctgtcttctctgtgagcagctcacntcacttggccgggcgagtcgaggttcgttttggngcttgttcgccttggtttacaaaacggaaaaagggggngaacggtacccctaaggtcctgtctctcggtanaaaccgngacgtagggaaggtagacgtcccgtacgtaggttcagtcgaccgtagtccgtagggtcgggtcggggacccggtaggtccactccgtaccaacctagttcgccgtaccgtcggccggtaccgtagaagtcttccgtgacttaactttgtttctgtcatactagtatacagttcgtccgtcccgtttataccgtttaggccgtacggggacctaaggtcgtaaggaaactacgaaacgacgtgtacggctcgacctacgtattccgtagttccttactcttcccgtcccgtactatacg

SEQ ID NO: 71630 - DNA, 640 bp, Homo sapiens
  misc_feature: GYAE6OF02GV7KI.44.59.F04.1.454.CMB.1.raw
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (318)..(318): a, c, t, g, unknown or other
  misc_feature (318)..(318): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcacatcacttgccggngagtcaggttcgttttcggngcttgttgccttggtttacaaacgaaaaagggggngacggtcccctaaggtcctcgtactcgtcgtagaaaccngactggaaggtagacgtcccgtcacggttcagtcgaccgagtccgaggtggtcgggcgacgtccactcgtcactattacgacggtaccgtgcggccgtagtaagtactttcgtcgtactaactttactttcgtgtacagtactaagtattacagtacgtccgtcccgtttactaccgttttcggaccggtacggggaacctacgacgttaaggaaactaacgaaacggacttagggtacggtaccgtacggtaacctaaccctagttaccgtttcgttacctttaccgtaccttcccgtttacccccgtaccgtacttaccg

SEQ ID NO: 71631 - DNA, 606 bp, Homo sapiens
  misc_feature: GYAE6OF02FWF5C.44.59.F04.1.454.CMB.1.raw
  modified_base (245)..(245): a, c, t, g, unknown or other
  misc_feature (245)..(245): n is a, c, g, or t
  modified_base (276)..(276): a, c, t, g, unknown or other
  misc_feature (276)..(276): n is a, c, g, or t
  modified_base (313)..(313): a, c, t, g, unknown or other
  misc_feature (313)..(313): n is a, c, g, or t
tcagacagtatatacacgaccggtgctcgatttagtacacacacttagggattgggggcatgagtcagaccctgtcaggggacagcatggacatgagggtccccgctcagctcccggggctcctgctgctctggctcccaggttcgagatgtgacatcgagatgacccagtctccttccttcctgtcttcttctgttggaggcagcgtcaccatcacttgccgggcagtcaggttcgttttcggngctgttgcctggtttacaaacgaaaaggggngacggcccctaaggtcctcgtctcgtcgtagaaaccngactaggaagtagacgtcccgtcaggttcagtcaccgagtccgagggtggtcgggccgagtccactctaccactagtacgcaccgtgccgctagaacgtatctgactacttattctagtcagctagttactctatcgtccgtcccttacgtacgttttcggaccgtacgggacctaaggtcgtaacgtaaatacgaaacgtagttacggtacgtacgtacggactaaccgtacttccgttacgttccgtttaccgtaaccgttcccgttaccccgtacctacgttccgtaacg

SEQ ID NO: 71632 - DNA, 739 bp, Homo sapiens
  misc_feature: GYAE6OF02GVOMC.44.59.F04.1.454.CMB.1.raw
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtcctccttccttcctgttcttcttctgttggagcagcgtcaccatcacttgccgggcgagtcgaggttcgttttcggngtctgttcgccttggtttacaaacggaaaaaggggngacggccccgtaaggtcctcgtctctcgtacgaaaccagacgtaggaaggtacgacgtcccgtacacgggttcaggtccgaccacgtccgtagggtcggggtcgggcccgggtagtcccgtacgtctccgaaccgtatttaacgggccgtacccgttcggacccgggtccttacgggaaacgtacttttcgtacggtaaccttaaaccgttttacgttttcgttacggttaccgtaacggtcgttaaacgttcgtttaaccaacgtttacggttaccggtttaccccccggtttatttaccggtttttaccgggaccccgggtaacggggaaacccgtacgtacggttaaccggtaaaacgttaccgtaaaaacgtaccggttacggtacggtaccgtacggaaccgaaccttacgtcttacgttctacctacgttcccgttcccacgtacttcg

SEQ ID NO: 71633 - DNA, 652 bp, Homo sapiens
  misc_feature: GYAE6OF02G23JI.44.59.F04.1.454.CMB.1.raw
  modified_base (327)..(327): a, c, t, g, unknown or other
  misc_feature (327)..(327): n is a, c, g, or t
  modified_base (447)..(447): a, c, t, g, unknown or other
  misc_feature (447)..(447): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttcgccgggcgagtcaggttcgttttcggtgcttggttcgccgttggtttacaaaacggaaaaagggggacgacggaccccgtaaggtcctcgtctcgtcgtacgaaccngacgtggaaggtagacgtcccgtcaggttcagtcgccagtccgagggttcggtgggccgggtacgtccacttccgtacaacctagttacggccgaccctcgggccggtcctaggaacgtntttcgtagaccttaactttatttcgtcgtacgacgtctaggtatacatacgtccgtacccgttcttacgttttcgggacccgtacggggtaacctaacggccgttaagggaaactaccgaaaacgtaccgttagtcggtaccgtaggacctaacccgtagttccgttgttaccttccgtacttccccgttcccgtactaccttcg

SEQ ID NO: 71634 - DNA, 633 bp, Homo sapiens
  misc_feature: GYAE6OF02FYLLA.44.59.F04.1.454.CMB.1.raw
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (322)..(322): a, c, t, g, unknown or other
  misc_feature (322)..(322): n is a, c, g, or t
  modified_base (358)..(358): a, c, t, g, unknown or other
  misc_feature (358)..(358): n is a, c, g, or t
tcagacagtatatacacgaccggtgctcgatttagtacacacacttagggagttgggggcatgagtcagaccctgtcagggacagcatggacatgagggtcccgctcagctcctgggctcctgctgctctggctcccaggttcgagatgtgacatcgagatgacccagtctccttcctcctgtcttcttctgttggagcagcgtcaccatcacttcgccggcagtcagtcgtttcgngctgtgcctgtttcacgaaaaggggnacgccctaaggtctcgtctctcgtcgaacncgactggaaggtacgacggtcccgtacgngtttcaagttgccgagtccaggtgggtcggaccggngtccactctcaccattacgccgacgtgccggacgtttcgaaagtcgtttacgtacggcttaaaccgttcgtttaacgcgtttacccgagttaccaagttagtctaaagttcggtccttaccccgtttactccggtttttacggcccggtaacggggaaccctaacggccgttaagtaaaccgtcgaaaaaccgtccgttagggcgtcgtaacgtaccgacccgtattacgttccgttacggtactaccgttcccttaccccggtctacgttaccg

SEQ ID NO: 71635 - DNA, 830 bp, Homo sapiens
  misc_feature: GYAE6OF02HNZNL.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttggccgggcgagtcgaggttcgttttcggtgtcgttgtttcgccgtttaggttttaccaaaaacggaaaaaaacgggggggtcgaaccgggtaccccccgtttaaacgggttcccgtttccggttcccgtttcccgttaacgggtaaccggaaaaacccgtaacgggtaacccgttaaggggttaaaacgggttacgggtaaccggtttccccccggttaacggtacggggttttaccgaaacgggttcggacccgttaggtacccgtaaggggttcggggttaccgggggacccgggtaacgttccccgtaacgttcctacccgaaacctagtttacgacccgggtacctacgggcccgggtaccttacgggtaaacgttacgtttccgttacggtaaccttaaacttttacgtttcgttacgtacgtacgtacgttaacgtttactaacgtacgttacgttaccgttccccgtttacgttaaccggtttttcgggaacccgtacggggaacctaaggtccgtaaggtaaacgtaaacgaaacgtacgtcggtaggtcctacggcctaacctcgttcgtcgttactactacttccctcccgactacttacg

SEQ ID NO: 71636 - DNA, 834 bp, Homo sapiens
  misc_feature: GYAE6OF02IIXEU.44.59.F04.1.454.CMB.1.raw
  modified_base (254)..(254): a, c, t, g, unknown or other
  misc_feature (254)..(254): n is a, c, g, or t
tcagacagtatatacacgaccggtgctcgatttagtacacacacttaggattgggggcgatgagttcagaccctgtcaggggacagcatggacatgaagggtaccccgatcagctcctggggctcctgctgctcgtggcctcccaggttcgagactgtgacatcgagatcgacccagtctccttccttcctgttccttcttctgttcggaggcagcgtccaccatcacttcgccgggcagtcaggtcgtttcgngctgttcgccgttggtttcaaaacgtaaaagggggcacgggaccccttaaggtccctcgtccgtctccggtagaaacccgtgacgtggggtaagtagtacggtcccgttaccgaaggttccaaggttcggaccctaggtacccgtaaggggttcgggtaccggggaccccggtacgttaccccgaacgttcccgttaccgaaaccccttaagtttaccgggtacccgaaacccgtttcggggacccgggttacccgttaacggtaaaccgggttactttaccggttaccggtaaccgttaaaccgttttaacgttttccgttacggttacctacggtaccgtaacggttaaccttaccggtaaacgttccggttaaccgttccccgtttacgttaccggtttttaccgggacccggttaacgggggtaaccctaacggtaccgttaaacgggtaaaccgttaacgaaacccgtaaccgttacgggttcgggttaccgttaccggtccgtaacctaacgttccgttacggttaccgtttaccgttaccgttaccccggttaacccgtcccgtacgttaccg

SEQ ID NO: 71637 - DNA, 751 bp, Homo sapiens
  misc_feature: GYAE6OF02G2DQE.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttctgtcttcttctgttggagcagcgtcacatcacttgccgggcgagtcaggttcgttttcggcgtctggttcgccgttgggtttaccaaaacggtaaaaagggggagtacggccccgtaaggtcctcgtccttccgtcgtacgaaaccgagtaccgtgggaaacggtcgacgtccccggtcgtacggttcacggttcggacccgtaggtccgtagggtcggggtcggggaccgggtacgtcccgtaacttccgtaccacctaagtttacggcccgtacccgtcgggtaccggtcccgttaaggaaacgtactttccgtacgtacttaaaccgttttattttaccgtacggttaccacgtacgtaagttaacttacgtaacgtttacggtccgttccccgtttacgttaccgttttaccgggaccgtaaccgggggtaacctaacgggtacgttaacggtaaaactaccgtaaaaccgtagttacggtacggtaccgtacggaccctaaccgtaacttccgttacgttacccgtttactaccgtttacccgttccccggtactaccttaccg

SEQ ID NO: 71638 - DNA, 647 bp, Homo sapiens
  misc_feature: GYAE6OF02FK2IG.44.59.F04.1.454.CMB.1.raw
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggaggcagctcaccatcacttgccggcgagtcaggttcgttttcggcttgttcgccgttggttacaaacgaaaaggggnacggcccctaaggtcctcgtctctacgtcgaaaccngacgtggaaggtagacgtccccgtcaggttcagtcgaccagtccgaggtcgggtcgggccggacgtcctacgtcctcacctagttacgccgtaccgtcgccggtcctaggaatcgttcgcgaccttaatttctttcgtgtaccaggtactagttactactagtaccgttccgtaccccgtttcttacgttttccgggaccgtaacgggggtaaccctaagggttaccgtaaggtaaaaccgttcgaaaccgttaacgttcggtagtccgtacgacctacctaacgttccttacggttacttccgtaccgtttcccgtacccgtactactttccgg

SEQ ID NO: 71639 - DNA, 731 bp, Homo sapiens
  misc_feature: GYAE6OF02JUG7C.44.59.F04.1.454.CMB.1.raw
  modified_base (158)..(158): a, c, t, g, unknown or other
  misc_feature (158)..(158): n is a, c, g, or t
  modified_base (529)..(529): a, c, t, g, unknown or other
  misc_feature (529)..(529): n is a, c, g, or t
tcagacagtatatacacgaccggtgctcgatttagtacacacacttagggattgggggcgatgagtcagaccctgtcaggggacagcatggacatgagggtccccgctcagctctggggctcctgctgctctggctcccgaggttcgagactgtgacntcgagatcgacctagtctccttccttcctgttcttcttctggttggaggtcgagtccgcacctatcctacgttggcccgggtacgtacgtcgtaggttcgtttcggtgtcttgttcgtccgttgtttacgaaaacggaaagggggacgtaccggaccccggttacggtaccgtcgttaccgtcgtacggttacgaaaccgtagtacgaggtaacggtagaccggtcccgtacgtaggtactcggtgccgaggtcgcggtgggccggcggtactcccgtactcgtaccacgtatacgtccgaccgtcggtccggtacgtacgaagttcgttacgcggtacttacgttactttcgtcgtaccgtctaacggtnttacgtacgtacgttagggtcccttaccccggttttctttaacggttttccggggaacccggttacgggaaccgtaacggtacgttaacgtaaactaacccgtaaagtccgtagtaccggacgtccgtaacgtaaccggtatccgttttccgttacttacgtttaccccgttcccgtttaccccgtaccgttaccttaacgg

SEQ ID NO: 71640 - DNA, 679 bp, Homo sapiens
  misc_feature: GYAE6OF02HFBJL.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtccttccttccttcctgtcttcttctgttggagcagcgtcaccatcacttcggccgggcgagtcgaggttccgttttcgggtgcgttgttcgtccgttgggtttaaccaaaacggaaaaagggggcgaacggtaccccgtaagggttccctcgttctccgtacggtacgaaaccagacgtagggaaggtacgacgtcccgtacgaggttcagtcgaccgacgtccgagggtcgggtacgggccgggtacgtaccacctccgtaccaaccttagtacgaccgtacctcgggccgtcgtagaacgtattcgtatactaacgttactttcgactcgacgtacgtagttatactagttacgtccctcccgtttattaccggtttccggaccgggtaacgggtacctaaggtccgtaaggtaaacctacgaaacccgttagtcggtaacgtcgtcgtaaccgtcctacgttacgtacgttcgttactaccgttacccgtccccgattacttacg

SEQ ID NO: 71641 - DNA, 738 bp, Homo sapiens
  misc_feature: GYAE6OF02H1VCV.44.59.F04.1.454.CMB.1.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtcctccttccttcctgtcttcttctgttgagcagcgtcaccatcacttggcgggcgagtctaggttcgttttcggngcttgttcgccgttggtttacaaacggtaaaaagggggngtacggaccccgtaaggtcctcgtactcgtcgtacgaaaccagactgggaagtagacgtcccgtcgtaaggttcagtcgcctagtccgagggtggtcgggccggtagtcctactctacaccgtattacgccgtacgtcgggccggtacctaggaacgtactttcgtacgtaccgtaaacttttcttccgttcgtaccgtaggtacctaggtttactaccgtaagttacggtccggttacccccgtttattaaccggttttaccggaacccgggtaagggggttaaacccctaaggttaccggttaaacgggtaaaaccttaaccgaaaaaccgggttccgttagggtaccggtaccgtaccggtaacccgtaacccgttaacgtttcccgtacgttttaccccgttacgtttaccccttaacccggtttcccccggtacctacgtttaacccg

SEQ ID NO: 71642 - DNA, 712 bp, Homo sapiens
  misc_feature: GYAE6OF02FLZRJ.44.59.F04.1.454.CMB.1.raw
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (274)..(274): a, c, t, g, unknown or other
  misc_feature (274)..(274): n is a, c, g, or t
  modified_base (310)..(310): a, c, t, g, unknown or other
  misc_feature (310)..(310): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatgacccagtctccttccttcctgtcttcttctgttggagcagcgtcacntcacttgccgggcagtcaggtcgttttcggngctgttgccttggtttcaaacgtaaaaggggngacggcccctaaggtcctcgtctcgtcgtagaaccngtacgtggaacgtgtacgtcccgtcgagttcagtcgaccgacgtccgaggttcgggtgggaccggtacgttacccgacgttcgtacaaccgtagttaccggaccgtacccgtggacccggtcctaggaaacgtacgtttcgtacggtctaaaccgtttactttcgttacgtaccgtaggtactaacgttacttacgtaagttccgtccggttaccccgtttacgttaaccgttttcgggacccgttaacgggggacccttaaggtccttaaagggtaaaccttaccgtaaacccgtaacgttcgggtacggtacggttacgaccgttaacccgtacggtttaccttaccgggttaccttaccgtaaccgttcccggtttaccccgtaccgttacgttaaccg

SEQ ID NO: 71643 - DNA, 639 bp, Homo sapiens
  misc_feature: GYAE6OF02GLZ5C.44.59.F04.1.454.CMB.1.raw
  modified_base (113)..(113): a, c, t, g, unknown or other
  misc_feature (113)..(113): n is a, c, g, or t
  modified_base (265)..(265): a, c, t, g, unknown or other
  misc_feature (265)..(265): n is a, c, g, or t
  modified_base (305)..(305): a, c, t, g, unknown or other
  misc_feature (305)..(305): n is a, c, g, or t
  modified_base (553)..(553): a, c, t, g, unknown or other
  misc_feature (553)..(553): n is a, c, g, or t
  modified_base (593)..(593): a, c, t, g, unknown or other
  misc_feature (593)..(593): n is a, c, g, or t
  modified_base (631)..(631): a, c, t, g, unknown or other
  misc_feature (631)..(631): n is a, c, g, or t
tcagacagtatatacacgaccggtgctcgatttagtacacacacttagggattgggggggcatgacgtcagacccgtgtcaggggacagcgatggacagtcgagggtccccgntctacgcgtcctcggggctcctgcctgcgtctcggcgtcccaggttcgagtactgtcgacatcgagatgacccagtcctccttccttctgtcttcttctgttggaggcagcgtcaccatcacttcgccgggcgagtcgacggttcgtttcgngtctggttcgtccttggtttacaaacggtaaaacgggggnaaccggtaaccccgtaaaggtccgtccggtactccttaccggtacgaaacctggtaacgtagggtaacggtacgtacgtacccgtacgtacggttacgagttcgaccctaggtccgagggtgtcggggccggtacgtccgacgtctacgacgtaagttcggccgtaccgtgaccgtccgtagaacgtctttcgagtactaaactttcgtctcggtacagtcttagtactctaagtcgtcgtacccttnttaacgttcgacgacggtacagtctagaactcgaaacggntggacgtgcgacacgtagttcgtcgtactcgcgttccnccatatcg

SEQ ID NO: 71644 - DNA, 703 bp, Homo sapiens
  misc_feature: GYAE6OF02JAD0Q.44.59.F04.1.454.CMB.1.raw
tcagacagtatatacacgaccggtgctcgatttagtacacacacttagggattgggggcatgagtcagaccctgtcaggggacagcatggacatggagggtccccgctcagctcctggggctcctgctgctctggctcccaggttcgagatgtgacatcgagatgacccagtcctccttccttctgtctttcttctggttggaggcagcgtcaccatcacgttggccgggcgagtcgtaggttccgttttcggctcttgttgtcccgttggttttaccaaaacggtaaaaaaggggggagtaacggacccccgttaagggttacccttcggtccttccgttcgtaacgaaaccgagtacgtggtaaaggtacggtacgtccccgtaccgtaggttcctaggtgacccgtagtaccgtagggtcgggtacggggccggtacgtccgacgtacgtccactaacgtcgccgactcggccgccgtagaacgtattcgtgtactactttattcttgactcgactagtacttcaattacggtccgtcccccgttattaccggtttcggtacccggaaacggggtacctaacggtcgttaaagggaaaccctaaacgtaaacgaaccggttgttaacggccgtaacgacgtaacctacgttcgttacggtttaccttgtaacccttccggttaccccgtctaaccttcgg

SEQ ID NO: 71645 - DNA, 689 bp, Homo sapiens
  misc_feature: GYAE6OF02FHE6W.44.59.F04.1.454.CMB.1.raw
tcagacagtatatacacgaccggtgctcgatttagtacacacacttagggattgggggcatgagtcagaccctgtcagggacagcatggacatgagggtcccgctcagatcctggggctcctgctgctctggctcccaggttcgagatgtgacatcgagatgacccagtcctccttccttcctgtcttctctgttgacggcagcgtcaccatcacttcgccgggcgagtcgaggttcgttttcggtcgtcttggttcgccgttggttttaccaaaacgaaaaagggggtgacggtacccccgtaaggtccctcgttactccgttcgtacgaaaccctagtaccgtagggaaaggttacgtacggttccccggtccgtaggtttaccacggtcgcctaaggttcccgagggttcggggtaccggggccggtacggtacctaaccttctacccgacctaagtttaccgaccggtacccgtggcccggtacctaggtaacgtaatttccgtacgtccctaaaccgttttatttcccgttagttcagcttagtactcgtaagtcggtaccggtccccgtttattaccgtttcggacccgaacgggtaaccaagtaccgtaagtaaacctacgaaacgtacttggacgtcgctccaaccgtcttcgcttctctaccgttcctcccgactatccg

SEQ ID NO: 71646 - DNA, 717 bp, Homo sapiens
  misc_feature: GYAE6OF02H98FJ.44.59.F04.1.454.CMB.1.raw
  modified_base (548)..(548): a, c, t, g, unknown or other
  misc_feature (548)..(548): n is a, c, g, or t
  modified_base (649)..(649): a, c, t, g, unknown or other
  misc_feature (649)..(649): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtcctccttccttcctgtcttcttctggttggagcagcgtcacctatcctacgttcggccgggcgagtcgtaggttcgttttcggtgtcttgttcgccttggttacaaacggaaaaggggcgacggtaccccgtaacggtcctcgtctcgtaccggtacgaaacctaggtacgtagggtaaggtacggaccggttccccgtccgtacggttccgaggtcgacctacggtccggaggttcggggtcggggaccggtacgtaccctaccgtctaccgtacctacgttaacgccgtaccgtcgccgtcctagacgtcttcgcgtaccttaatttctctcgtacacgtattagtactacgacttcggtccctacccggtttnttaccggttttaccggccgggtaaccgggtacctaagggtacgttaaacggtaaactaaccggtaaaaccgtggtacgggttaacgtccggtacgaacccnccgttaacgttccgttacggttaccttcccgttaccgttcccccgtttaccccgacttattaacccgg

SEQ ID NO: 71647 - DNA, 708 bp, Homo sapiens
  misc_feature: GYAE6OF02IYS05.44.59.F04.1.454.CMB.1.raw
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (282)..(282): a, c, t, g, unknown or other
  misc_feature (282)..(282): n is a, c, g, or t
tcagacagtatatacacgaccggtgctcgatttagtacacacacttagggattgggggcatgagtcagacccctgtcaggggacagcatggacatgagggtccccgctcagctccgtggggctcctgctgctctggcctcccaggttcgagatgtgacatcgagntcgacccagtcctccttccttctgtcttcttntgtggagcagctcacntcatcgccggnagtcgtaggttcgttcggngcttgttcgcctttaggttaccaaaacggaaaagggggnaccggtaccccctaggttccctcgtctccgtacggtacgaaaaccgtggtaaccgtgggaaacggttacgaccggttccccgtacgtagggtttaccaacggttcgacccgtaaggttcccggagggtttcggggccggggacccggtagtccccgaacttcctacccaacttaagtccgccggaccttgggcccggtacgtagaaacgtcgttacgcgtaacttaactttattcgtacggtaccagtactaagtacgtactagttcgtccggtacccgtttactacggtttccggaccggtaacgggtaaccacggtacgttaggactaaaccgttaccgaaagtaccgttggtaccggtctaccgaccgtaccttaacgttcgtttacggttcttaccgcccgtttcccgtacccgtacttacg

SEQ ID NO: 71648 - DNA, 785 bp, Homo sapiens
  misc_feature: GYAE6OF02GD5HD.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcccgggctcctgctgctctggctcccaggttcgagatgtgacatcgagatgacccagtcctccttccttctgtcttcttctgttggaggcagcgtcaccatcacgttggccgggcgagtcgtaggttcgttttcggtgtctgttcgtccgttggtttacgaaacggaaaaagggggtcgacggtacccctaagggtccttcgtcttactcgagaaaccagacgtaggaaggtagacgtcccgtctaggttcaggtcgccgtacggtccgtagggtgggtcggggccggtacgtcccgtacgtctaccgaccgtaagtttacgcccggtaaccgttgggcccgggtacctaggtaacgtacgtttcctacggtaaccttaaaccgttttacgttttccgttacgttaccgtaacgtaccgtaagttacctacttaacggttacggttcccgttacccccgtttacgttacccggtttttacgggacccgggtaacgggggtaaccctaaacgggtaccgttaagggtaaaaccgttaaccggaaaaaccgttaaccggttagggtaccggtacgttaccgggtaaccctaacccggtagttacccgttacggtttaccttacccggttacctttacccccggtttacccgtacccgttacgttacccttaacgg

SEQ ID NO: 71649 - DNA, 653 bp, Homo sapiens
  misc_feature: GYAE6OF02HL12G.44.59.F04.1.454.CMB.1.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgacccagtcctccttccttcctgtcttctctgttggagcagctcactatcacttcgccgggcgagtcgtaggtttccgttttcggtgtcgttgttcggtccttggttttaaccaaaacggtaaaaagggggngtaccggaccccgtaagggtccttcgtctcgtcgtacgaaaccacggacgtaggaaggtacgacgtcccgtcgtaggttcagtcgccngtccaggtgggcggcggtacgtccactcnctacatacgccgactgccgctagaatcttcgngtcctaactttgtttcgtctacgacgtctaagtctcgtaattcggtccttacccgttcttaccggttttcggaccgtacgggtaacctaacgtcgtaaacggtaaactaaccgtaaacgtacgttacggtcggtacgtcgaacccgtacctcgttcgttaccgttcccgttacgtaaccgtttcccccttaccgtcctacttaaccgg

SEQ ID NO: 71650 - DNA, 856 bp, Homo sapiens
  misc_feature: GYAE6OF02ITPJ5.44.59.F04.1.454.CMB.1.raw
  modified_base (133)..(133): a, c, t, g, unknown or other
  misc_feature (133)..(133): n is a, c, g, or t
  modified_base (151)..(151): a, c, t, g, unknown or other
  misc_feature (151)..(151): n is a, c, g, or t
tcagacagtatatacacgaccggtgctcgatttagtacacacacttagggattgggggcatgagtcagaccctgtcaggggacagcatggacatgagggtccccgctcagcctccgtggggctcctgctgctntggctcccaggttcgagntgtgacatcgagatcgacccagtctccttcctctgtcttcttctggttggagcagtccgtcacctatcacgttcgcccggggacgtagttccgtagggtttccggttttcgggtcgtccgttaggttcggtaccccgtttaggggttttacccaaaaaacgggtaaaaaaacggggggggactaccggggtacccccccgttaaagggttcccgttccggtcctttccgttaacggtaccggaaaacccgtaggtaccggttagggggaaacggttacggaccgtttaccccggtaccgtaagggtttcgagggttaccgccggtaacggtcccgtaggggtcgggtaccggggtcccgggtaacggttccgaccgttccgtaaccgtaaccttaggttacgacccggtacccgttcggggaccggttacccggtacggtaaacgttaccggtttacctaacgggttaccttaaaaccgtttttcggttttacgttacggtacccgttaacggtacttaaacggttcttaaacgtactttaacgggtttcccggttacccccgttagtttacccgttttcgggaccggtacggggtaaaccgtaggtaccgttaaggaaacctaacgaaaccgttactgggtacggtacctggtacccacgtacttgtccgttaccttactactttccccgtacctcctattccg

SEQ ID NO: 71651 - DNA, 849 bp, Homo sapiens
  misc_feature: GYAE6OF02FUGOB.44.59.F04.1.454.CMB.1.raw
  modified_base (164)..(164): a, c, t, g, unknown or other
  misc_feature (164)..(164): n is a, c, g, or t
tcagacagtatatacacgaccggtgctcgatttagtacacacacttagggattgggggcatgagtcagaccctgtcaggggacagcatggacatgagggtccccgctcagcctcctggggctcctgctgctcgtggcctcccaggttcgagatgtgacatcganagtcgacccagtcctccttccttcctgttcttcttctgttggacgcagtccgtaccacctatctacgttcggccggcgtagtcgtaggttccgtttggtcgtcgttggttcgccgttaggtttaccgaaaacggtaaaaacgggggtcaccgggtaccccgtaaacggttcccgttccggttcctccgttaccggtaacggaaaaccgtacggtaaccggtagggaaaggttacggtacccgtccccggtacgttaacgggttccgaggtccggtaccgtacggtcccggtaggggttccggggtacggggacccgggtacggttacccgtaccttaccgtacccgtaacctaaggttacccggtacccggttacccggtcgggtaacccgggtaccggttaacggtaaacgttaccgtttccgtaaccggttaccttaaaccgttttcgttaccgttacgtaccgtacgaaccgttaagttacttacgttacgttacggtccgttacccctttacggttaccgtttaccgggaccggttacggggtaacgtaacggtaccgttaaacggtaaacttaaccgtaacggttacggttacgacggtacccgtttacgaccgtaaccttccgttaccgttacgttaccgtaacgttcccgttacccgttcccgtacccttctaaccgg

SEQ ID NO: 71652 - DNA, 772 bp, Homo sapiens
  misc_feature: GYAE6OF02JRU7C.44.59.F04.1.454.CMB.1.raw
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
  modified_base (389)..(389): a, c, t, g, unknown or other
  misc_feature (389)..(389): n is a, c, g, or t
tcagacagtatatacacgaccggtgctcgatttagtacacacacttagggattggggagagaagacaggattcaggacaatctcagcatggccggcttcctctcctcctcaccctcctcactcactgtgcagggtcctgggccctagtctgtgctgactcagccatcctcaggcgtcgtcgggaccccgggnagacggtcacgtnttctttgtctcggaagtcgtccaactgtacggaattatacgtatacgtggtanccggtntaattcagaggtgaccggtcccacgtccctnactctagtagggactaatcgacggccgccctaggtaccggggtccctacgaccgttattccctgtctccgtaccgtagtcgtcgacctacctcnctccgtcctcgggactaagtcgtacgggtcgggtacccgttccgggtacgaacggacgttcgggacggtacgttagtttaaccttttcgtttacggttggtcgggtttaaccgggttcggttttaggggacgtttaccggaaccgttacggtttccgtagggtccggtttagggtacccggttacggtttacccgttaacggggtttaacccgggggacggggaaccggtaaacccgtaccgggttaccgtaccgggtttaccccgttacggttaccggacgtaaccccgggtaccgtaaccggttcccgtaccccggtttccccggtacggttacctcccggtttaacccgttcccggtttaaccccctcccgtttaacccg

SEQ ID NO: 71653 - DNA, 1004 bp, Homo sapiens
  misc_feature: GYAE6OF02GUTOR.44.59.F04.1.454.CMB.1.raw
  modified_base (279)..(279): a, c, t, g, unknown or other
  misc_feature (279)..(279): n is a, c, g, or t
tcagacagtatatacacgaccggtgctcgatttagtacacacacttagggagttgggggcatgagtcagaccctgtcgagggacagcatggacatgaggtccccgctcagcctcctgggctcctgctgcctctggcctcccgaggttcgagactgtcgactatcgagtatcgacccagtcctccgttccttccgtgtcttcttcgtggttcggagtcagtccgtacacctagtctacgttcggccgggtactacgtcgtacgggtttccgttttacggntcgttagttcgtcccgtttaggtttaaccaaaaacgggtaaaaaggggggcgtaaccgggtacccccttaaaagggttccccgttaccggttaccttaccggttaccggtaacgtaaaccccaggtacgtaggggtaaaacggtacgtaccggttaccccggtacgttacgggttacgacgttacccggaccgtcgggtaccccggtaaggggttcggggtaccggggttacccgggaacgttccccgtaccgttacccgtacccgaaaccggttaaaccgtttaaacccggaccccggtcggtaccccgggtaccgtttaacgggtaaacggtttaccgtttaccggtacggttaaacccgtttaaccgtttttaccgtttaccgttaccggtaccgttaaacggtaccggtttaacgttaaccgtttaaccgttaacggtttaaccggtttccccggtttaacccccggttttacgtttaaccgggttttttacccggggaacccgggttaaccgggggtaaacccttaaccgggttaaccggttaaaccggttaaaacgttaaaccccggtaaaaaccgttaacgggtttaccgggtttacgggaacccgttaccgggtaaccccttaaccggtaaccgtttcccggtttaacgtttccccgtttaacccggtacctttacccccggttacccccggtaactttacccttaccggttaacgg

SEQ ID NO: 71654 - DNA, 834 bp, Homo sapiens
  misc_feature: GYAE6OF02G2RT7.44.59.F04.1.454.CMB.1.raw
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagactgtgacatcgagtatcgacccagtctccttccttcctgtcttcttctgttggagcagcgtcaccatctacttggccgggacgagtcgagggtttccgttttcggacgtcgttggttcgtcccgttgggtttaaccaaaacggtaaaaaaggggggcgaccggtacccccgttaagggtcccttacgtccttccgtccggtaacgaaacccgtacggtaccgtaggggaacggtacggtaccggttccccggtacgtaggttaccaggtcgaccgtacgttccggtagggtcgggtcgggggaccccggtacgtaccctacgtacctaccgaacctaagttacgaccggtaccgtcgggaccggtaccctaggtaactacgtttcccgtaacgtacccttaaacgttttacgtttaccgttgttacccgagttaaccgtaagtttaactccttaaacggttcgttacccggttcccccggttttactttaaccggttttacccgggaccgggttaaccggggtaaccctaacgggttaccgtttaaacgggtaaaaccgttaaaccgaaacggttaaccgtcgggtttaacgtaccgttacggaaccctaccggttaccttaccgtttcgtttaccggttaccgttaacccgttaccccgtttacccggtaccttaagtttcccg

SEQ ID NO: 71655 - DNA, 722 bp, Homo sapiens
  misc_feature: GYAE6OF02ID6C2.44.59.F04.1.454.CMB.1.raw
  modified_base (106)..(106): a, c, t, g, unknown or other
  misc_feature (106)..(106): n is a, c, g, or t
  modified_base (269)..(269): a, c, t, g, unknown or other
  misc_feature (269)..(269): n is a, c, g, or t
tcagacagtatatacacgaccggtgctcgatttagtacacacacttagggattgggggcatgagtcagaccctgtcaggggacagcatggacatgagggtccccgntcagctcccgggctcctgctgctctggcctcccgaggttcgagtatgtgactatcgagatcgaccctagtcctccttccttcctgttcttcttcgtggttaggacgtcagtccgtaccactatccacgttggtacgggctaggtctagggtttccgttttggntacgttgttcgtccgtttaggtttaaccgaaaacggtaaaaaggggggctaccggtaccccgttaacggttccctcgtcctccgttacgtaccgaaaaccgcggtaacgtagggaacggtacggtacgtccccgtcgaggttcgagtcgaccgaggttccgaggggttcggcggggccggtactccgaccttcacgaacctagttacgacccgacgtcggaccggtccgtagtaacgtactttcgacgtaaccttaagtttactttcgtacgtacaggtacctaggttaactacgtacgttaacgtccccgttaccttacgttacggtttccggaccgggaagtccgaaggttcaaagttaaaccaccgtaaagtacgtgtacgcgttaccgaccgtactcttcgttacgttacctacgttaccgttccccgttccgaaccttggttctaacg

SEQ ID NO: 71656 - DNA, 671 bp, Homo sapiens
  misc_feature: GYAE6OF02JTKGO.44.59.F04.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (275)..(275): a, c, t, g, unknown or other
  misc_feature (275)..(275): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
tcagacagtatatacacgaccggtgctcgatttagtacacacacttagggattggggagcttcagctgtggtagagaagacaggattcaggacaatctccagcatggccgcttccctctcctcctcaccctcctcactcactgtgcagggtcctgggcccagtctgtgctgactcagccatcctcagcgtctcgggacccccggnacgcggtcaacgtnttcgttttgtctaggaagtacggtccaacagtcggaattaattactatactggtancggtcaattcanaggagcggtacccagacccctnactctagagganatcgagcgcctacgacgggtccncgaccgtatctctcgcctcaacgtctacggccacgtccacgtccctcccgnggtccattcncggtacggccgtcccggtacggacgagtacggngtccgtagtactttacgttcgttcggtacggtccggtacggttagggacgttaccggaacgttcgttaccgtgggtaaccggttacgggtacttcggtaacgtttaccggttacggggaccggggtaacggtaacccggtaaacggttcccgggtacgtaccccggttaaccgttacggtacccggtaccgtacccggtaacggtccgttaccccggtccccggttaacccgg

SEQ ID NO: 71657 - DNA, 779 bp, Homo sapiens
  misc_feature: GYAE6OF02GGSGY.44.59.F04.1.454.CMB.1.raw
  modified_base (184)..(184): a, c, t, g, unknown or other
  misc_feature (184)..(184): n is a, c, g, or t
  modified_base (256)..(256): a, c, t, g, unknown or other
  misc_feature (256)..(256): n is a, c, g, or t
  modified_base (756)..(756): a, c, t, g, unknown or other
  misc_feature (756)..(756): n is a, c, g, or t
tcagacagtatatacacgaccggtgctcgatttagtacacacacttagggattgggggagtcagaccctgtcaggggacagcatggacatgagggtccccgctcagctcctggggctcctgctgctctggcctcccaggttcgagatggtgacatcgagtatcgaccagtcttccttccttctntcttcttctgttggaggtcagtcgtcaccatctacgttcggccgggcgacgtcgtacgggttcgttttcggngtccgttggttcgtccgttgggttttacgaaaacggtaaaaaaggggggtacgaacgggtacccccgtttaaaggttcccgttaccggttccgtccgtttaccggtaaccggtaaaacccaggtaaccgtaaggggtaaagggttaacggtaaccggttaccccggttaccgtaacgggtttaccgtaggttaccgtacccggtacgttacccggtaaggggttacggggtcgggggtacccggtacggttacccgtaacgtccgttacccgtaaacccgttaacgtttaacggacccggtaccgttccgggacccggtacccgtaagggtaacggttcgttttacccgtgtaacccgttaaacgttttacgttttcgtacgttacgagtactaaggttactcgttaaatcggttcctcccgttctacgtttcggccgacgggtacagtcgtaagtaacgtacaaacgactgtcgactcgctagtactcttacgtcttcnttacctccgctcgtctagtatac

SEQ ID NO: 71658 - DNA, 773 bp, Homo sapiens
  misc_feature: GYAE6OF02F941X.44.59.F04.1.454.CMB.1.raw
  modified_base (251)..(251): a, c, t, g, unknown or other
  misc_feature (251)..(251): n is a, c, g, or t
tcagacagtatatacacgaccggtgctcgatttagtacacacacttagggtagttgggggcatgagtcagaccctgtcagggacagcatggacatgagggtccccgctcaagctcctggggctcctgctgctctggctcccaggttcgagtatgtgacactacgagatgacccagtctaccttccttcctgtcttcttctgttggagcagcgtcaccgatcacgttggccggcgacgtcaggtcgtttggngctgttcgccttggtttacaacgaaaaggggagacggtacccctaaggtcctcgtcttctcgtagaaaccagtacgtggaaggtagtacggtccccgtacgacggtttacgaggttcgaccgtacggtacctaagggtcggggttacgggggacccggtacgtaccgtaccgttacgtaccaaaccgttaacgtttaacgggcccggttaaacccgttcggacccgggtccctttagggaaaacggttctttaccgtacggtaacttaaacccgttttagtttaccgttaagttaccgtacgtccgtaaggttacttactacgttaaccgtcgtacccccggtttattaaccggtttttacgggacccgtaagggggtaaccctaaggttcgttaacgggtaaaacttaccgaaaacggtaaccgttgggtaacggtaccgttaggaccctaaccgtaaccgttcgttacggtaccgtttaccgtaaccgttcccgtttccccgaccggttaacttacccgg

SEQ ID NO: 71659 - DNA, 718 bp, Homo sapiens
  misc_feature: GYAE6OF02H4QEA.44.59.F04.1.454.CMB.1.raw
  modified_base (275)..(275): a, c, t, g, unknown or other
  misc_feature (275)..(275): n is a, c, g, or t
  modified_base (534)..(534): a, c, t, g, unknown or other
  misc_feature (534)..(534): n is a, c, g, or t
  modified_base (553)..(553): a, c, t, g, unknown or other
  misc_feature (553)..(553): n is a, c, g, or t
  modified_base (711)..(711): a, c, t, g, unknown or other
  misc_feature (711)..(711): n is a, c, g, or t
tcagacagtatatacacgaccggtgctcgatttagtacacacacttagggattgggggcatgagtcagaccctgtcaggggacagcatggacatgagggtcccccgctcagctccgtggggcctcctgctgctcgtggcctcccgaggttcgagtatgtgacatcgagatcgacccagttcctccttccttcctgtcttcttctggttggaggcagcgtacacctatctacgttcggaccgggcgtaaggtcgtacgggtttcgggttttccggngtccgttggttacgtccgtttagggttaacgaaaacgggtaaaaaaggggggtcgaaccgggtaccccgttaaacgggtcccttacggtccttacgtaccggtaaacggaaaccgaagtacggtaagggtaagggtacgtaccggtccccgtacgtaggttacaggtccgacgacgtcgagggtcgggtcgggaccggtacgtaccacgtcgtaccactaagtacgccgacgtcggtaccggcctaaggatcttcgtanccttaattcgttctacgtntacacgtagtatagacgtcgtccgtacccgttattaccggtttaccggaccggaacgggtaccaacggttctaacgggaaactaacgaaacgtacgttcggtaccgtacgcgtaccaacgacgtttcacggttctacctacgttcccttacccgactnttaaccg

SEQ ID NO: 71660 - DNA, 802 bp, Homo sapiens
  misc_feature: GYAE6OF02IAVKR.44.59.F04.1.454.CMB.1.raw
  modified_base (168)..(168): a, c, t, g, unknown or other
  misc_feature (168)..(168): n is a, c, g, or t
  modified_base (192)..(192): a, c, t, g, unknown or other
  misc_feature (192)..(192): n is a, c, g, or t
  modified_base (205)..(205): a, c, t, g, unknown or other
  misc_feature (205)..(205): n is a, c, g, or t
tcagacagtatatacacgaccggtgctcgatttagtacacacacttagggattggggagcttcagctgtggtagagaagacaggattcaggacaatctccagcatggccggcttcccgtctcctctcaccctctcactcactgtgctaggtcctgggcccagtctgtnctgactcagccatcctcagcgtcncgggacccccggnacgacgtcacgtacttcttttgtacgtaggaaacgtacggtaccaacgtagtacggtaaaagttaacttaacgttaacttacgttaggtactacggactaacgttacgaacgtacggacgtacccggtaccccacgtacccccttactacgttacgtaagacggtaacgtaactacgaacggtccggtacccgtacggtaccgggtccctacggaaccgtattaccgtctaccggtacctacgtaacgttccgtacggacctaccgtaccgaccgttcccgtacccgtgtaccctacgtaccggtacggttcgggtaccccgttacccgggtaaccggtagggtaacgtacgggtaacggtccgttaacggtttaacgttttaacgtttcgttacggttaccggtacggggttacgttaaggggtactacggtaaccgtacggttaccgtagggtaacgttacggacccgttagtacccgttacggttaccgggaccgggtaaaccgggaaccgtaacggtaccgtaccggtaaccccgttacgtaaccggtactaccggtaacccgtacggtacccgtaccccggtaccccgtacg

SEQ ID NO: 71661 - DNA, 722 bp, Homo sapiens
  misc_feature: GYAE6OF02F6MOZ.44.59.F04.1.454.CMB.1.raw
  modified_base (249)..(249): a, c, t, g, unknown or other
  misc_feature (249)..(249): n is a, c, g, or t
  modified_base (717)..(717): a, c, t, g, unknown or other
  misc_feature (717)..(717): n is a, c, g, or t
tcagacagtatatacacgaccggtgctcgatttagtacacacacttagggattgggggcatgagtcagaccctgtcgggggacagcatggacatgagggtccccgctcagctcctggggctcctgctgctctggctcccaggttcgagatgtgacatcgagatgacccagtcctccttccttcctgtcttcttctgttggagcagcgtcaccatcacgttgccgggcgagtcgaggttcgttttccggngtccttgttcgccgttggttttaccaaaacgtaaaaaggggggacgtaacgggaccccccgttaagggtccccttaccggttccgttacccccggttagaaaacccgagtaaccggttagggaaacgggttacggaccgttccccggtaccgtagggttccagttcggcccgtaggtcccgaggggttcggtcgggaccggtacgtcccgtactccgtaccaaccgtattaaccggccgtaccgtcggacccggtcctaggaacgtactttccgtagtacccgttaaatttcgtttctagttcgtaacgtcgtaagttacttacagttacgtccgtaccccgtttattacggttttcggaccggacgggtacctacgttacggtaagtaataccgaaagtacgttgacggtctagccgaccgtattccttacgttctacctctttacccgtcccgacttcttaccgtnttaac

SEQ ID NO: 71662 - DNA, 689 bp, Homo sapiens
  misc_feature: GYAE6OF02JNGMD.44.59.F04.1.454.CMB.1.raw
  modified_base (191)..(191): a, c, t, g, unknown or other
  misc_feature (191)..(191): n is a, c, g, or t
  modified_base (212)..(212): a, c, t, g, unknown or other
  misc_feature (212)..(212): n is a, c, g, or t
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
tcagacagtatatacacgaccggtgctcgatttagtacacacacttagggattgggggcatgagtcagaccctgtcaggggacagcatggacatgagggtccccgctcagctcctggggctcctgctgctctggctcccaggttcgagatgtgacatcgagatcgaccagtctccttcctctgtcttcttntgttggagtcagtcgtcactntctactggccggcgtagtcgaggttcgttttcggngtcttgttcgtccttaggtttaccaaacggaaaacgggggngaaccggtccccgtaaggtcctcgtcttccgtacgtaacgaaccgtcgtaacgtgggaacgttacgaccgtcccgtacgtacggttcagtcgacctacggtccgagggttcgggtcgggtaccggtacgttccgacgtcctccaacgtacgttaacgtccgtaaccgtcgggccgtaccgttagaacgttacttaccgtcggtaccttaaacgtttcttttacgtcgtacgtacgtcgtagttacctctacgtacgtcccgtaccccgttacgttaccggtttacggcccggtaacgggaacctagtacggtaagtaaacctaagtaaaccgaccgtgtacggtacgtcgtaaccactcgttacgtacgtactttcgaccgttaccctcccgtacctagtc

SEQ ID NO: 71663 - DNA, 719 bp, Homo sapiens
  misc_feature: GYAE6OF02H9UGG.44.59.F04.1.454.CMB.1.raw
  modified_base (172)..(172): a, c, t, g, unknown or other
  misc_feature (172)..(172): n is a, c, g, or t
  modified_base (202)..(202): a, c, t, g, unknown or other
  misc_feature (202)..(202): n is a, c, g, or t
  modified_base (409)..(409): a, c, t, g, unknown or other
  misc_feature (409)..(409): n is a, c, g, or t
tcagacagtatatacacgaccggtgctcgatttagtacacacacttagggattgggggcatgagtcagaccctgtcaggggacagcatggacatgagggtcccccgctcagctcctggggctctgctgctctggcctcccgaggttcgagatgtgactatcgagatcgaccngtctccttcctctgtcttcttctggtaggngcagtcgtacacctatcctacgttcggccgggctacggtcgtacgggttaccgttttcgggcgttcgttggttcgtaccgtttaggttaccgaaaacgggtaaaagggggcgaccggtaccccgtaaggtcctcggtacctcgtaccggtaacgaaaccgtgacggtagggtaagtacggaccggttcccgtacggtaggttaccgngtacgaccgtacgtcggtagggtcggggtcggggaccggtctacccgtactccgtaccaccgttataccggccgtacgtcgggacccgtcgtaggaacgttcgttctaccgtaacttaccgttttatttccgacgtacgtagtactggttactacgttacgttcggtcccgttaccccgttgtttacccgttacggggccctaacggggactaacggtacgtaaacggaaactacgtaacgtggtcgtacgtctcgacctacttcgttacctagttcctacttcccgttacccgtctaccctattacccg

SEQ ID NO: 71664 - DNA, 791 bp, Homo sapiens
  misc_feature: GYAE6OF02GVJYH.44.59.F04.1.454.CMB.1.raw
  modified_base (235)..(235): a, c, t, g, unknown or other
  misc_feature (235)..(235): n is a, c, g, or t
  modified_base (254)..(254): a, c, t, g, unknown or other
  misc_feature (254)..(254): n is a, c, g, or t
  modified_base (360)..(360): a, c, t, g, unknown or other
  misc_feature (360)..(360): n is a, c, g, or t
tcagacagtatatacacgaccggtgctcgatttagtacacacacttagggattgggggcatgagtcagaccctgtcaggggacagcatggacatgagggtcccgctcagctcctgggctcctgctagctctggctccaggttccgagatgtgacatcgagatcgacccagtctccttccttcctgtacttcttcgtgttggacgcatcggtcacctactctaacttcggaccggngaagtcaggttcgtttggngctgttcgcgttgtttacaaacgtaaaaggggacgacggtaccccgtaaggtccgttacgtctactacgtcgaaaacctagacgtaggaggtagacgtcccggtanacggttcagtcaccgagtaccgtaggtcgggtacggggaccggcgtacctacgtaccgtacaaccgtaacgtttacggacccgttaacccgtcggccgggttacccgtaggaaaagttcgtacgtaggtaacctaacgtttaacgtttccgtacgtacgtaacgtaccgttaacgtaacttacgtaacgttaacgtacggttacccccgttacgttaaccggttttacggaacccgtaaggggggaaccttaacgggaccgttaaaggtaaaaccgtaaccggttaaaaccgaaaccgttcggggtaaacgtaccggtttaccgggaaacccttaaccccggtacgttaccggtttacgtttaacccggttttacccgtaaacccgtttccccgttttaaaccccccgggtacttaacccggttaacccgg

SEQ ID NO: 71665 - DNA, 651 bp, Homo sapiens
  misc_feature: GYAE6OF02F62JN.44.59.F04.1.454.CMB.1.raw
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (625)..(625): a, c, t, g, unknown or other
  misc_feature (625)..(625): n is a, c, g, or t
tcagacagtatatacacgaccggtgctcgatttagtacacacacttagggattgggggcatgagtcagaccctgtcaggggacagcatggacatgagggtcccgctcagctcctggggctcctgctgctctggctccaggttcgagatgtagacagtcgagatcgaccctagtcctcctttccttactgttcttcttctggttggaggtcagcgtcacatcacttcgccggnagtcaggttcgtttcgnctgtncgtgttcaagaaaggganacggccctaggtcctcgtctctcggtcgtaaccagacgtggaacggtagacggtcccgtacgacggttcagtcgcctaggtccgaggttggggtacggccgggtacgtaccgtccgtacgtcgaaccgtagtttacgccgtaccgtcggccggctaggtaacgtacttccgtagtaccctaaacgttttactttcgttacgacgttacgtagtaacgttagttccaagtttacgtaccgtccccgttacgttacgttttcgggacccgtacggggacctaacggcgtaacggtaactaacgaaacgtacgtgtacggcgtaacgtaccgtaacgcttaggtcttccgtttacncctttacccggtccctacgtgttacg

SEQ ID NO: 71666 - DNA, 174 bp, Homo sapiens
  misc_feature: GYAE6OF01BZPIA.21.26.C04.1.454.CMB.1.raw
  modified_base (173)..(174): a, c, t, g, unknown or other
  misc_feature (173)..(174): n is a, c, g, or t
tcagtcgtcgctcgcacgaccggtgctcgatttagtctagcgactttgggtttggggaagaggaagactgacggccctgctccaggagcacctccgagagcacagcggccctgggctgcctggtcaaggactattccctcgtctctactgagcgggctggcaaggcgcatagnn

SEQ ID NO: 71667 - DNA, 202 bp, Homo sapiens
  misc_feature: GYAE6OF01DWY2U.21.26.C04.1.454.CMB.1.raw
  modified_base (178)..(202): a, c, t, g, unknown or other
  misc_feature (178)..(202): n is a, c, g, or t
tcagtcgtcgctcgcacgaccggtgctcgatttagtctagcgactttgggttttggggaaggaggaaagactcgacggccctgctccaggagcacctccgagagcacagcggccctgggctgcctggtcaaggtactacttccctgtctctactgagcgggctggcaaggcgcatagnnnnnnnnnnnnnnnnnnnnnnnnn

SEQ ID NO: 71668 - DNA, 179 bp, Homo sapiens
  misc_feature: GYAE6OF01CI2O3.21.26.C04.1.454.CMB.1.raw
  modified_base (175)..(179): a, c, t, g, unknown or other
  misc_feature (175)..(179): n is a, c, g, or t
tcagtcgtcgctcgcacgaccggtgctcgatttagtctagcgactttgggttttgggggaagaggaagactgacggccctgctccaggagcacctccgagagcacagcggccctgggctgcctggtcaaggactacttcctcgtctctactgagcgggctggcaaggcgcatagnnnnn

SEQ ID NO: 71669 - DNA, 177 bp, Homo sapiens
  misc_feature: GYAE6OF01CZG9C.21.26.C04.1.454.CMB.1.raw
  modified_base (175)..(177): a, c, t, g, unknown or other
  misc_feature (175)..(177): n is a, c, g, or t
tcagtcgtcgctcgcacgaccggtgctcgatttagtctagcgactttgggttttgggggaagaggaagactgacggccctgctccaggagcacctccgagagcacagcggccctgggctgcctggtcaaggactacttcctcgtctctactgagcgggctggcaaggcgcatagnnn

SEQ ID NO: 71670 - DNA, 173 bp, Homo sapiens
  misc_feature: GYAE6OF01DDL77.21.26.C04.1.454.CMB.1.raw
  modified_base (173)..(173): a, c, t, g, unknown or other
  misc_feature (173)..(173): n is a, c, g, or t
tcagtcgtcgctcgcacgaccggtgctcgatttagtctagcgactttgggtttgggaagaggaagactgacggccctgctccaggagcacctccgagagcacagcggccctgggctgcctggtcaaggactacttccctcgtctctactgagcgggctggcaaggcgcatagn

SEQ ID NO: 71671 - DNA, 202 bp, Homo sapiens
  misc_feature: GYAE6OF01B0NY3.21.26.C04.1.454.CMB.1.raw
  modified_base (173)..(202): a, c, t, g, unknown or other
  misc_feature (173)..(202): n is a, c, g, or t
tcagtcgtcgctcgcacgaccggtgctcgatttagtctagcgactttgggtttggggaagaggaagactgacggccctgctccaggagcacctccgagagcacagcggccctgggctgcctggtcaaggactacttccctcgtctctactgagcggctggcaaggcgcatagnnnnnnnnnnnnnnnnnnnnnnnnnnnnnn

SEQ ID NO: 71672 - DNA, 533 bp, Homo sapiens
  misc_feature: GYAE6OF01DPVMV.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaacccacagagaccctcacgctgacctgcaccttctctgggttttcactcagtaccactgcagtgggtgtgggctggatccgtcagccccccggaaaggccccggagtggcttgcactcatttattggaatgatgataaccatacagcccatctctgaggaccaggctcaccctcacgaagacaccgacaaaaaccaggtgtcctaacactgaccaacatggaccccatggacacagccacatactactgtgcacacgggagtggctgggtgtgggactacgtggggccagggagtcctggtcaccgtctcctcagcctccaccaagggcccatccggtctcccctggccgccctgcctccaggcgccacctccgagagcacgacgg

SEQ ID NO: 71673 - DNA, 544 bp, Homo sapiens
  misc_feature: GYAE6OF01DESX1.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcaccctcacgaaggacaccgaccaaaaaccaggtggtcctaacactgaccaacatggaccccatggacacagccacatactactgtgcacacgggagtggctgggtgtgggactacgtggggccagggagtcctggtcaccgtctcctcagcctccaccaagggcccagtccggtcctcccccgtggccgccctgcctccgacggcgccacctccgagacgcacgacgg

SEQ ID NO: 71674 - DNA, 176 bp, Homo sapiens
  misc_feature: GYAE6OF01DEZKT.21.26.C04.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagtctagcgactttgggttttgggggaagaggaagactgacggccctgctccaggagcacctccgagagcacagcggccctgggctgcctggtcaaggactacttccctcgtctctactgagcgggctggcaaggcgcatagn

SEQ ID NO: 71675 - DNA, 578 bp, Homo sapiens
  misc_feature: GYAE6OF01DXDDO.21.26.C04.1.454.CMB.1.raw
  modified_base (321)..(321): a, c, t, g, unknown or other
  misc_feature (321)..(321): n is a, c, g, or t
  modified_base (565)..(565): a, c, t, g, unknown or other
  misc_feature (565)..(565): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttatggaatgatgataaccactacagcccatctctgaggaccaggctcaccctnacgaaggacaccgacaaaaaccaggtcgtacctaacactgaaccaaacatcggaccccatggacacagccaacatactactgtgcaacacgggagtggctgggtgtgggactacgtggggaccagggacgtccgtggtccaccggtctcctcgacgccctccaccaacgggcccagttccggtaccttccccccgaggtcccgcccctgccctcccgagggtaccgccacccgttccgagaccncgaccgaaccggg

SEQ ID NO: 71676 - DNA, 176 bp, Homo sapiens
  misc_feature: GYAE6OF01CV134.21.26.C04.1.454.CMB.1.raw
  modified_base (175)..(176): a, c, t, g, unknown or other
  misc_feature (175)..(176): n is a, c, g, or t
tcagtcgtcgctcgcacgaccggtgctcgatttagtctagcgactttgggttttgggggaagaggaagactgacggccctgctccaggagcacctccgagagcacagcggccctgggctgcctggtcaaggactacttcctcgtctctactgagcgggctggcaaggcgcatagnn

SEQ ID NO: 71677 - DNA, 569 bp, Homo sapiens
  misc_feature: GYAE6OF01BG1MP.21.26.C04.1.454.CMB.1.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagtcgtcgctcgcacgaccggtgctcgatttagtctagcgactttgggtttgggggaagaggaagactgaccggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggactccggtcacgcccccggaaaggccccggagtggcttgcactcatttatggaatgatgataaccactacagcccatctctgaggaccaggctcaccctnacgaagacaccgaccaaaacnggtacggtacctaacactgaaccaacatacggaccccatcggaacacagccacatactactgtcgacacgacgggacgtggcgtagggtgtagggactacgtcgggccagggacgtccgtaggtccaccgtctcctcgacgcctccaccgaacgggcccacgtccggtcttcccccgtggcccgccgtgcctccgaggcgctaccgtcgagacgcgcgacgg

SEQ ID NO: 71678 - DNA, 552 bp, Homo sapiens
  misc_feature: GYAE6OF01EV6JF.21.26.C04.1.454.CMB.1.raw
  modified_base (346)..(346): a, c, t, g, unknown or other
  misc_feature (346)..(346): n is a, c, g, or t
  modified_base (504)..(504): a, c, t, g, unknown or other
  misc_feature (504)..(504): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgccaaaaaccnggtggtcctaacactgaccaacatggaccccatggacacagccacatactactgtgcacacgggagtggcgtgggtgtgggactacgtggggccagggagtcctggtcaccgtctcctcacgcctccaccaacgggcccagtccggtccttcccccgnggcccgtccctgcctccgaggacgccaccctccgagacgcacgaccgg

SEQ ID NO: 71679 - DNA, 551 bp, Homo sapiens
  misc_feature: GYAE6OF01BJB8B.21.26.C04.1.454.CMB.1.raw
  modified_base (445)..(445): a, c, t, g, unknown or other
  misc_feature (445)..(445): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcaccctcacgaaggacaccgaccaaaaaccaggtcgtacctaacactagaccaacatggaccccatggacacacgcacatactactgtgcacacgggagtggctgggtgtgggactacgtggggcagggngtcctggccacgtctcctcagccctccaccgaacggcccatccggtccttcccccgtggccgcccgtgcctcccgaggcgccacccgtccgaagcgccacgaccgg

SEQ ID NO: 71680 - DNA, 176 bp, Homo sapiens; identical to SEQ ID NO: 71674
  misc_feature: GYAE6OF01ASLN9.21.26.C04.1.454.CMB.1.raw
  modified_base (176)..(176): a, c, t, g, unknown or other
  misc_feature (176)..(176): n is a, c, g, or t

SEQ ID NO: 71681 - DNA, 549 bp, Homo sapiens
  misc_feature: GYAE6OF01CPX3Z.21.26.C04.1.454.CMB.1.raw
  modified_base (527)..(527): a, c, t, g, unknown or other
  misc_feature (527)..(527): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcaccctcacgaaggacaccgaccaaaaaccaggtggtcctaacactgaccaacatcggaccccatggacacagccacatactactgtgcacacgggagtggctgggtgtggggactacgtggggccaggggagtccgtggtcaccgtctcctcagtcctccaccaacgggcccagtccggtccttccccctggccgccctgcctccgaggcncctacctcgagacgcacgacgg

SEQ ID NO: 71682 - DNA, 566 bp, Homo sapiens
  misc_feature: GYAE6OF01DM5QC.21.26.C04.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcaccctnacgaaggacacccgaccaaaaaccagggtgtcctaacactgaccaaacatcggaccccatggacacagccacatactactgtgcaacgacgggagtggctggggtgtgggactacgtggggccaggggacgtcctggtccaccgtctccctcacgtcctaccaccaacgggccccagtcccggttccttcccccgtggcccgtccctggcctccgaggacgccacctccgagacgcacgacggg

SEQ ID NO: 71683 - DNA, 554 bp, Homo sapiens
  misc_feature: GYAE6OF01A6AIK.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcaccctcacgaaggacaccgccaaaaaccaggtggtcctaacactgaccaacatggaccccatggacacagccacatactactgtgcacacgggagtggctgggtgtgggactacgtggggccagggacgtccgtggtccaccgtctccctcacgtccctccaccgaacgggcccatccggtccttcccccgtggccgcccctgcctccgaggacgccacctccgagacgcgacgacgg

SEQ ID NO: 71684 - DNA, 613 bp, Homo sapiens
  misc_feature: GYAE6OF01AP2OK.21.26.C04.1.454.CMB.1.raw
  modified_base (352)..(352): a, c, t, g, unknown or other
  misc_feature (352)..(352): n is a, c, g, or t
  modified_base (427)..(427): a, c, t, g, unknown or other
  misc_feature (427)..(427): n is a, c, g, or t
  modified_base (556)..(556): a, c, t, g, unknown or other
  misc_feature (556)..(556): n is a, c, g, or t
  modified_base (583)..(583): a, c, t, g, unknown or other
  misc_feature (583)..(583): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggccccggagtggcttgcactctatttattggaatgatgataaccactacacgcccatctctgacggaccaggctcaccctcacgaacggacaccgaccaaaaaccgnggtcggtacctaacacctagaacccaaacactacggaaccccatcggaaccacacgaccaacactactactgtancaacgacggggatggcgtggggtgtagggactacggtggggccgaggggtctccgtggtacccaccggtcctccgtccgacgtccctccgaaccgaacgggcccctacggtcccggtcccttcccccgngggcccgcccgtgccgtccgaacggcnccgtacccgccggagacgccacgacccggg

SEQ ID NO: 71685 - DNA, 178 bp, Homo sapiens
  misc_feature: GYAE6OF01C5AJO.21.26.C04.1.454.CMB.1.raw
  modified_base (176)..(178): a, c, t, g, unknown or other
  misc_feature (176)..(178): n is a, c, g, or t
tcagtcgtcgctcgcacgaccggtgctcgatttagtctagcgactttgggttttgggggaagaggaagactgacggccctgctccaggagcacctccgagagcacagcggccctgggctgcctggtcaaggactacttccctcgtctctactgagcgggctggcaaggcgcatagnnn

SEQ ID NO: 71686 - DNA, 176 bp, Homo sapiens; identical to SEQ ID NO: 71674
  misc_feature: GYAE6OF01CH74K.21.26.C04.1.454.CMB.1.raw
  modified_base (176)..(176): a, c, t, g, unknown or other
  misc_feature (176)..(176): n is a, c, g, or t

SEQ ID NO: 71687 - DNA, 616 bp, Homo sapiens
  misc_feature: GYAE6OF01BTLLF.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcaccctcacgaaggacaccgacctaaaaaccaggtacgtacctaacactgaaccaacatcggaccccatcgacacagccacatactactgtgacacacgggagtggcgtgggtgtgggactacgtggggccagggacgtccgtggtcctaccggtcctcccgtcgaccgtccctccgaccgaacggggcccctacgttcccgggttcccttccccccggtggccccggtcccgtacggccccttccgaacgggacgtcccgtaacccgtcccgggaacgacggtcccgaaccgacccgggg

SEQ ID NO: 71688 - DNA, 176 bp, Homo sapiens; identical to SEQ ID NO: 71676
  misc_feature: GYAE6OF01C13J6.21.26.C04.1.454.CMB.1.raw
  modified_base (175)..(176): a, c, t, g, unknown or other
  misc_feature (175)..(176): n is a, c, g, or t

SEQ ID NO: 71689 - DNA, 592 bp, Homo sapiens
  misc_feature: GYAE6OF01DHU6E.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgaggaccaggctcaccctcacgaacggacaccgaccaaaaaaccaggtcggtacctaacactacgaacccaaacactcggaccccatcggacacagccacatactactgtgcacacgggagtggctgggtgtgggactacgtggggccagggacgttccgtggtccaccggtctcctccgagccctccaacccgaacgggcccctaagttcccgggtccttccccccgtgggcccgtccccttggccttcccggaggacgccacccgtacccgagacgccacgaccgg

SEQ ID NO: 71690 - DNA, 564 bp, Homo sapiens
  misc_feature: GYAE6OF01CKG5W.21.26.C04.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcattattggaatgatgataaccactacagcccatctctgagaccaggctcacctcacgaaggacaccgaccaaaaaccnggtacggtcctaacactgaccaaacatggaccccatggacacagccacatactactgtgcacacgggagtggactgggtgtgggactacgtggggccagggacgtccgtggtccaccgtctcctcacgcctccaccaagggcccaagtccggtccttcccccgtgcccgtccctgccttcccgacggacgccgaaccctcccggagacggcaacgaccggg

SEQ ID NO: 71691 - DNA, 732 bp, Homo sapiens
  misc_feature: GYAE6OF01B90QS.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacggctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgagaccaggcctcacctcacgaacgacaccgaccaaaaccgaggtcgtacctaacactgaaccaacatacggaccccagtacggacaccagaccacagtaactactgtagaccaaccgacggggtagtcgggtccgtggggtacgtcggggaaccttaaccgggttcgggggacccaagggggtacgttccccggtgggttacccgacccggttccgttccccgttaccggaccgtacccccgtaccccgaaccggtaaaccccggggtcccctaacgggttaccccggttccccctttcccccccgggtcgggtacccccggtccccccgttaggtacccccgttcccggaaaccgggacccggtacccctaaccccgggttacccgggaaaccggacccgaccccgaacccggtacccccggggg

SEQ ID NO: 71692 - DNA, 564 bp, Homo sapiens
  misc_feature: GYAE6OF01D4Z7U.21.26.C04.1.454.CMB.1.raw
  modified_base (348)..(348): a, c, t, g, unknown or other
  misc_feature (348)..(348): n is a, c, g, or t
  modified_base (521)..(521): a, c, t, g, unknown or other
  misc_feature (521)..(521): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgaggaccaggctcaccctcacgaaggaccaccgaccaaaaaccnggtcgtacctaacactacgaaccaacatcggaccccatcggacacacgccacatactactgtgcacgacgggagtggcgtgggtgtgggactacgtggggccgaggggacgtccgtggtccaccgtcctcctcgacgccctccaccgaacgggcccagtccggtcctccccgnggccgccctgcctccgaggcgccaccctcgagcgcacgaccgg

SEQ ID NO: 71693 - DNA, 654 bp, Homo sapiens
  misc_feature: GYAE6OF01DT4HU.21.26.C04.1.454.CMB.1.raw
  modified_base (377)..(377): a, c, t, g, unknown or other
  misc_feature (377)..(377): n is a, c, g, or t
  modified_base (453)..(453): a, c, t, g, unknown or other
  misc_feature (453)..(453): n is a, c, g, or t
tcagtcgtcgctcgcacgaccggtgctcgatttagtctagcgactttgggtttgggggggtaagaggaagactgacggtcctgctgctgaccatcccttcatgggtcttgtcccagatcaccttgaaggagtctggtccccacgctgggtagaaacccgacagagacccctcgtaccgctgacctgtcacctttctctgggttttcactcagtaccactgcagtgggtgtgggctggatccgtcacgcccccggaaaggccccggagtggcttgcctactctattttattggaactgatgataacctactacagtcccatctctgacggaccaggcctccaccctacgaacggaacggacaccgtaccaaaaaccgnggtacgtacctaaacactacgaaccaaacaactacggaccccagtacggactacagaccacgactactactgtacncacgacgggagtacgacgtgggtagtaggactacgtgggaccagggtacgtccgtaggtccaccgtctacctcgacgtccctaccgaccgaacgggccccaagttccggtaccttcccccgtaggccccggtccctcggacctacccggacggaccgtcccgtaacccgttcccggaacgtaccgtccgaccgtacccggg

SEQ ID NO: 71694 - DNA, 583 bp, Homo sapiens
  misc_feature: GYAE6OF01B94GN.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcacctcacgaagacaccgacaaaaccaggtcgtactaacactgaaccaacatcggacccatcggacacagccacatactactgtgcacgacgggagtggcgtgggtgtgggactacgtggggccagggacgtccgtggtccacgtctcctcacgcctccaccgaacggcccaagtccggtcccttcccccgtcggcccgtccccgtggcccttcccgacgggtaccgcccgtaacccgtcccggaagaccggccgaccgacccggg

SEQ ID NO: 71695 - DNA, 568 bp, Homo sapiens
  misc_feature: GYAE6OF01ESAIT.21.26.C04.1.454.CMB.1.raw
  modified_base (345)..(345): a, c, t, g, unknown or other
  misc_feature (345)..(345): n is a, c, g, or t
  modified_base (522)..(522): a, c, t, g, unknown or other
  misc_feature (522)..(522): n is a, c, g, or t
  modified_base (562)..(562): a, c, t, g, unknown or other
  misc_feature (562)..(562): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgaggaccaggctcaccctcacgaggacaccgaccaaaaacnggtgtacctaacactgaccaacatcggaccccagtggacacacgccacatactactgtcgccaacgacgggagtgggcgtggggtagtgggactacggtcgggggccaggggacgtccgtcggtccaccgtctccctcgacgcctccaccaacgggcccagtccgtccttcccccgnggcccgccctgccctccgacggcgccgacctccgagcgcncgacgg

SEQ ID NO: 71696 - DNA, 176 bp, Homo sapiens; identical to SEQ ID NO: 71674
  misc_feature: GYAE6OF01C36OQ.21.26.C04.1.454.CMB.1.raw
  modified_base (176)..(176): a, c, t, g, unknown or other
  misc_feature (176)..(176): n is a, c, g, or t

SEQ ID NO: 71697 - DNA, 551 bp, Homo sapiens
  misc_feature: GYAE6OF01B60UI.21.26.C04.1.454.CMB.1.raw
  modified_base (348)..(348): a, c, t, g, unknown or other
  misc_feature (348)..(348): n is a, c, g, or t
  modified_base (449)..(449): a, c, t, g, unknown or other
  misc_feature (449)..(449): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggattttcactcagtaccactgcagtgggtgtgggctggatccgtcagccccccggaaaggccccggagtggcttgcactcatttattggaatgatgataaccactacagccccatctctgaggaccaggctcaccctcacgaaggacaccgccaaaaaccnggtcggtcctaacactgaccaacatcggaccccatggacacagccacatactactgtgcacgacgggagtggctgggtgtgggactacgtggggccagggngtccgtggtcaccgtctcctcacgcctccaccgacggcccagtccgtcctccccgtggccgccctgcctccgaggacgccacccgtaccgagtacgcgaacg

SEQ ID NO: 71698 - DNA, 684 bp, Homo sapiens
  misc_feature: GYAE6OF01D1S5Y.21.26.C04.1.454.CMB.1.raw
  modified_base (322)..(322): a, c, t, g, unknown or other
  misc_feature (322)..(322): n is a, c, g, or t
  modified_base (345)..(345): a, c, t, g, unknown or other
  misc_feature (345)..(345): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttatggaatgatgataaccactacagcccatctctgaggaccaggctcaccctnacgagaccaccgaaccaaaacgnggtcgtaccaacactacgaaccaacacgaccggaaccccagtacgaccaacacgacccaacaacttaactacgtgtcgaccgaaccggacgggtaggtcggcggttggggttacggtacgggtaccgtacgggtcggggaccggtagggtaccggttccggtcggtcccgtacccgttcctcccgtaccgaccgtccctacccgaaccgaacccgggccctacgttcccggttccccttcccccggtcgggtccccgtccccgtaccggtcccgttacccggacgggtacccgaccccgtaccccggtaccggacggaccgacccgtaccggacccggg

SEQ ID NO: 71699 - DNA, 176 bp, Homo sapiens; identical to SEQ ID NO: 71674
  misc_feature: GYAE6OF01BBBQZ.21.26.C04.1.454.CMB.1.raw
  modified_base (176)..(176): a, c, t, g, unknown or other
  misc_feature (176)..(176): n is a, c, g, or t

SEQ ID NO: 71700 - DNA, 583 bp, Homo sapiens
  misc_feature: GYAE6OF01D3MRK.21.26.C04.1.454.CMB.1.raw
  modified_base (449)..(449): a, c, t, g, unknown or other
  misc_feature (449)..(449): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccatacagcccatctctgaggaccaggctcaccctcacgaaggaccaccgaccaaaaaccgaggtcggtacctaaacactcgaaccaacatcggaccccatcggacacacgccacatactactgtcgcacgacgggagtggctggggtgtgggacttacgnggggaccaggggacgtccgtggtccaccggttctcctcacgtccctccaccgaacgggcccagttccggtccttcccccgtggccgtccctgcctcccgaggaccgccgaccctccggagacgccgacgacggg

SEQ ID NO: 71701 - DNA, 574 bp, Homo sapiens
  misc_feature: GYAE6OF01A2CS9.21.26.C04.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaagccccggagtggcttgcactcatttatggaatgatgataaccactacagcccatctctgaggaccaggctcaccctcacgaaggacaccgaccaaaaaccnggtcggtaccctaacactgaacccaaacatcggaccccatcggacacagccacatactactgtgcacaagggagtggctgggtgtgggactacgtggggccagggacgtccgtggtccaccgtctcctcacgccctaccaccgaacgggcccagtccggtccttcccccgtgggcccgtcccgtgcctcccgacggacgccgacccgtaccggagacgccgacgaccggg

SEQ ID NO: 71702 - DNA, 595 bp, Homo sapiens
  misc_feature: GYAE6OF01CIR39.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggcctcaccctcacgaaggaccaccgaccaaaaaccaggtcggtacctaacactagaaccaacactacggacccatcggacacacgccacatactactgtcgcacgacgggagtggcgtgggtgtgggtactacggtggggccgaggggcgtccgtggtccaccgtctcctcacgtccctccgaaccgaacgggcccacgttcccgggtcccttcccccgtgggcccgcccgtcgccctccgacgggacgccctacccgtccggaagacgcaccgaccggg

SEQ ID NO: 71703 - DNA, 595 bp, Homo sapiens
  misc_feature: GYAE6OF01BQP05.21.26.C04.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgaggaccaggctcaccctcacgaagacaccgaccaaaaaccnggtcggtacctaaacactagaaccaaacactacggacccccagtacggaacacacgccaacactactaactgtcgcacgacgggagtcggcgtgggtgtagggactacgtggggcccagggacgtccgtcggtcaccgtctcctcgacgtccctccgaccaacgggcccacgtccggtcccttcccccgtggcccgtcccgtgccctcccgacggacgcccgtaccgtcccgagacgccgacgacccggg

SEQ ID NO: 71704 - DNA, 597 bp, Homo sapiens
  misc_feature: GYAE6OF01CGY25.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtgcttgcactcatttattggaatgatgataaccactacagcccatctctgaggaccaggcctcaccctcatgaaggaccaccgaccaaaaaccgaggtaggtacctaacactcgaacccaacactcggacccatcggacacacgaccacatacctactgtgcaacgacgggagtggcgtggggtggtacgggactacggtcggggccgaggggtacgtccgtgggtccacccgttctcccgtccacgccctcccgaaccgacgggtccccagttccggtcccttccccgtaggcccgtcccgtcgcctaccgaggaccgccacccgtccggaagcgcaccgg

SEQ ID NO: 71705 - DNA, 571 bp, Homo sapiens
  misc_feature: GYAE6OF01DUL3K.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgccaaaaaccaggtcgtacctaacactgaaccaacatggaccccatcggacacagccacatactactgtgcacacgggagtggctgggtgtgggactacgtggggccagggagtccgtggtcaccgtctcctcacgtcctccaccgaacgggcccagtccggtccttcccccgtggcccgccccgttggcccttcccgacgggagcccgacccttccggaagacgccacgaccggg

SEQ ID NO: 71706 - DNA, 573 bp, Homo sapiens
  misc_feature: GYAE6OF01CZAG7.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacacgcccatctctgacggaccaggctcaccctcacgaacggaccaccgaccaaaacnggtcgtcctaacactacgaccaacatcggaccccagtcggaacacacgccaacactactactgtcgcacgacgggagtggcgtggggtgtgggacgtacgtggggccgagggcgtccgtggtccaccgtctcctcacgccctccaccgacggcccagtccggtccttcccccgtggcccgtccctgcctccgacggcgacctaccgtaccgagacgcgacgcgg

SEQ ID NO: 71707 - DNA, 614 bp, Homo sapiens
  misc_feature: GYAE6OF01CT5DB.21.26.C04.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcacctcacgaaggacaccgacaaaaaccnggtacggtctaacactagaccaacatcggaccccatcggacacagccacatactactgtcgcaacgacgggagtggctgggtcgtgggactacgtggggaccaggggtacgtcctggtccaccggtctccgtacacgccctaccgaaccgaacgggccctaacgtcccggttaccctccccccgttagggcccgtccccgttggacccgttcccgaacgggaaccgccctaaccccgttaccggaacgtaccggccaaccgacccgggg

SEQ ID NO: 71708 - DNA, 560 bp, Homo sapiens
  misc_feature: GYAE6OF01BX00W.21.26.C04.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaagacaccgccaaaaaccngtggtcctaacactgaccaacatggaccccatggacacagccacatactactgtgcaacacgggagtggctgggtgtgggactacgtggggccagggagtccgtggtccaccgtctcctcagccctccaaccaacgggcccacgtccggtccttccccctgggcccgtccccgtgccctcccgaggacgccacccgtccgagcgcaccgacggg

SEQ ID NO: 71709 - DNA, 593 bp, Homo sapiens
  misc_feature: GYAE6OF01DAEKB.21.26.C04.1.454.CMB.1.raw
  modified_base (407)..(407): a, c, t, g, unknown or other
  misc_feature (407)..(407): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgaataaccactacagcccatctctgaggaccaggctcaccctcaacgaacggaccaccgaccaaaaaccgaggtcgtacctaacactacgaaccaaacatacggaaccccatcggacacacgccanactactactgtcgacacgacgggagtggcgtgggtgtgggacgtacggtcggggacagggtacgtcccgtggtccaccgtctcctcacgccctccgaaccgaacgggccctagtcccggttccctcccccgtggccccgtcccgtgccctccgacggacgccctacccgtccgagacgcacgccgg

SEQ ID NO: 71710 - DNA, 574 bp, Homo sapiens
  misc_feature: GYAE6OF01CVIO3.21.26.C04.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggacaccgccaaaaaccnggtgtacctaacactgaccaacatggaccccatcggacacagccacatactactgtgcacgacgggagtggcgtgggtgtgggactacgtggggccaggggacgtccgtggtccacccgtcctccgtcacgccctaccaccgacggcccacgtcccggtcccttccccgtggcccgtcccgtgcccgtccgacggacgcccgtacccgtccgagacgccacgaccggg

SEQ ID NO: 71711 - DNA, 570 bp, Homo sapiens
  misc_feature: GYAE6OF01C12LI.21.26.C04.1.454.CMB.1.raw
  modified_base (546)..(546): a, c, t, g, unknown or other
  misc_feature (546)..(546): n is a, c, g, or t
  modified_base (564)..(564): a, c, t, g, unknown or other
  misc_feature (564)..(564): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcaccctcacgaaggacaccgaccaaaaaccaggtggtcctaacactagaaccaacatcggaccccatggacacagccaacatactactgtcgcaacgacgggagtggcgtggggtgtgggactacgtggggcccaggggacgtccgtggtccaccgtctccctcgacgccctccaccgaacgggcccagtccggtcctcccccgtggcccgtccctgcctccgacgggcnccacccgtacgagacgcncgacgg

SEQ ID NO: 71712 - DNA, 176 bp, Homo sapiens; identical to SEQ ID NO: 71676
  misc_feature: GYAE6OF01CQR8R.21.26.C04.1.454.CMB.1.raw
  modified_base (175)..(176): a, c, t, g, unknown or other
  misc_feature (175)..(176): n is a, c, g, or t

SEQ ID NO: 71713 - DNA, 646 bp, Homo sapiens
  misc_feature: GYAE6OF01BP79H.21.26.C04.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactctatttatggaatgatgactaaccactacacgcccatctctgacggaccaggctcaccctcacgaacgaccaccgaccaaaacgnggtcgtaccaacactcgaaccaacacgtcggaccccatcggacacacgaccacactactactgtcgacacgacgggagtcggcgtggggtgtacgggtacgtacggtcggggaccgagggacgttccgtcggtacccaccgttcctcccgtccgaccgtccctacccgaacccgaacgggcccctaacgtcccgggttcccttcccccgtcgggccccgtccccgttcggcccttacccggaacgggaccgacccgtaccccgtacccggaacggacgacccgaccggacccggg

SEQ ID NO: 71714 - DNA, 589 bp, Homo sapiens
  misc_feature: GYAE6OF01A83QF.21.26.C04.1.454.CMB.1.raw
  modified_base (561)..(561): a, c, t, g, unknown or other
  misc_feature (561)..(561): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggaccaccgacccaaaaaaccaggtacggtaccctaacacctacgaaccaaacactcggaccccagtcgacacacgaccacatactactgtgccacgacgggagtggcgtgggtggtggactacggtcgggccgagggacgtccgtggtccaccgtctcctcacgtccctaccaccgaacgggcccagtccggtcccttccccgtggcccgccctgccgtcccgacgggcnccgaccgtcccgagcgccgacgaccggg

SEQ ID NO: 71715 - DNA, 654 bp, Homo sapiens
  misc_feature: GYAE6OF01CWUQZ.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcaggtgggtgtgggctggatccgtcacgcccccggaaaggccccggagtcggcttgcactcatttattggaatgatgataaccactacagcccatctctgagaccagctcaccctcacgaacggacaccgaccaaaaacgnggtacgtacctaacactacgaacctaacacgtcggaaccccagtacggaacacgacgaccaacgaactactaactgtacgacgaacgacgggagtcggcgtggggtcgtagggaactacggtcggggaccgagggtacgtccgtggtaccctaacccggttctacccgtacgaccgtccccgtaccgaacgtaaccgggccctaacgttccggttacccctccccgttgggaccccgtcccgtaggcccttacccggacggtcccgaccgtaccccgtaccggagtaccgccgaaccggtacccggg

SEQ ID NO: 71716 - DNA, 551 bp, Homo sapiens
  misc_feature: GYAE6OF01BV4MT.21.26.C04.1.454.CMB.1.raw
  modified_base (530)..(530): a, c, t, g, unknown or other
  misc_feature (530)..(530): n is a, c, g, or t
  modified_base (545)..(545): a, c, t, g, unknown or other
  misc_feature (545)..(545): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcaccctcacgaaggacaccgaccaaaaaccaggtcggtcctaacactgaaccaacatggaccccatcggacacagccacatactactgtgcacacgggagtggctgggtgtgggactacgtggggccagggacgtccgtggtccaccgtctcctcgacgcctccaccgaagggccccagtccggtccttccccctggccgccctgcctccaggcnccacctccgagcgcncgacgg

SEQ ID NO: 71717 - DNA, 614 bp, Homo sapiens
  misc_feature: GYAE6OF01A9F1H.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacacgcccatctctgaggaccaggctcaccctcacgaaggacaccgaccaaaaaccgaggtcggtacctaacactagaaccaacacgtacggacccccagtacggacacacgaccacaatactactcgtgaccacgaacgggagtcggcgtgggtgtgggactacggtcgggaccgagggcgtccgtggtccgaccgttcctcctcgaccgcccgtacccgacccgaacgggcccacgtccggtcccttcccccgtcggcccgtccccgtgcccgtcccgacggaccgccgtacccgtaccgaacgcgccgacgacccgggg

SEQ ID NO: 71718 - DNA, 642 bp, Homo sapiens
  misc_feature: GYAE6OF01CR4WM.21.26.C04.1.454.CMB.1.raw
  modified_base (342)..(342): a, c, t, g, unknown or other
  misc_feature (342)..(342): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctagtgaaacccacagagaccctcacgctgacctgcaccttctctgggttttcactcagtaccactgcagtgggtgtgggctggatccgtcacgcccccggaaaggccccggagtggcttgcactcattattggaatgatgataaccactacagcccatctctgaggaccaggctcacctcacgaagacacgaccaaaacngtgtctaacactgacaacatggaccccatcggacacacgccaacatactactgtcgcacgacgggaagttggcgttgggtggtgggtactacggtgggggaccaggggacgtccgtggtccacccgtctcctcgacgtcccgtacccaacccgtaacggggcccctaacgttcccgggttaccccgtttcccccccgtagggtccccgtcccccgttcggtcccgttccccggaacgggaccgacccgtaacccccgttaccccggaagggtaaacccggccgtaacccggaacccgggg

SEQ ID NO: 71719 - DNA, 202 bp, Homo sapiens
  misc_feature: GYAE6OF01ECSCW.21.26.C04.1.454.CMB.1.raw
  modified_base (177)..(202): a, c, t, g, unknown or other
  misc_feature (177)..(202): n is a, c, g, or t
tcagtcgtcgctcgcacgaccggtgctcgatttagtctagcgactttgggttttgggggaaggaggaagactgacggccctgctccaggagcacctccgagagcacagcggccctgggctgcctggtcaaggactacttccctcgtctctactgagcgggctggcaaggcgcatagnnnnnnnnnnnnnnnnnnnnnnnnnn

SEQ ID NO: 71720 - DNA, 566 bp, Homo sapiens
  misc_feature: GYAE6OF01BY0XW.21.26.C04.1.454.CMB.1.raw
  modified_base (346)..(346): a, c, t, g, unknown or other
  misc_feature (346)..(346): n is a, c, g, or t
  modified_base (558)..(558): a, c, t, g, unknown or other
  misc_feature (558)..(558): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctcacgaaggacaccgaccaaaaccgnggtcggtacctaacactgaaccaacatcggaccccatggacacagccacatactactgtcgcacgacgggagtggctgggtgtgggactacgtgggccagggacgtccgtggtccaccgtctcctcgacgtccctaccaccgaacgggccccagttcccggtccttcccccgtggcccgcccgtgccctccgacggcgaccacctccgagcncgcgacgg

SEQ ID NO: 71721 - DNA, 585 bp, Homo sapiens
  misc_feature: GYAE6OF01DX5RH.21.26.C04.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactctatttatggaatgatgataaccactacagcccatctctgaggaccaggctcaccctcacgaagacaccgaccaaaaccnggtcgtactaacactcgaaccaacatacgaccccatcgacacacgaccacatactactcgtcgacgacgacgggagtcggcgtggggtggtgggactacggtcgggccgagggtacgtccgtggtccaccgtcctctccgcgtaccctccaccgaacgggccctagtccgtccttcccccgtcggcccgcccgtgccctcccgacggacgaccgtacccgtcgagcgcccacgacccgg

SEQ ID NO: 71722 - DNA, 581 bp, Homo sapiens
  misc_feature: GYAE6OF01DG60A.21.26.C04.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaaccactacagcccatctctgaggaccaggctcaccctcacgaagacaccgaccaaaaaccaggtgtacctaacactgaaccaaacactcggaaccccatcggacacagccaacatactactgtncaacgacgggagtggcgtgggtgtggactacgtcggggccgagggcgtccgtggtccacccgtctccctcgacgccctaccgaaccgacgggcccagtccggttcctcccccgtggcccgcccgtgcctccgacggtacgccacccgtaccgaggacgccgacgaccggg

SEQ ID NO: 71723 - DNA, 566 bp, Homo sapiens
  misc_feature: GYAE6OF01EW2OU.21.26.C04.1.454.CMB.1.raw
  modified_base (351)..(351): a, c, t, g, unknown or other
  misc_feature (351)..(351): n is a, c, g, or t
  modified_base (398)..(398): a, c, t, g, unknown or other
  misc_feature (398)..(398): n is a, c, g, or t
tcagtcgtcgctcgcacgaccggtgctcgattttagtctagcgactttgggtttggggggaagaggaagactgacggtcctgctgctgaccatcccttcatgggtcttgtcccagatcaccttgaacggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaaccnggtcggtcctaacactgaccaacatggaccccatcggacacagccanatactactgtgcacgacgggatggctggggtgtgggactacgtgggggcccaggggacgttcctgggtccaccggtctcctcagtccctccaccaacgggcccagtccggtcccttcccccgtggcccgtccctgcctccgaggacgccacctccgagcgccacgcgg

SEQ ID NO: 71724 - DNA, 648 bp, Homo sapiens
  misc_feature: GYAE6OF01D5MC6.21.26.C04.1.454.CMB.1.raw
  modified_base (326)..(326): a, c, t, g, unknown or other
  misc_feature (326)..(326): n is a, c, g, or t
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcaggtgggtgtgggctggactccgtcacgcccccggaaaggccccggagtcggcttgcactcatttatggaatgatgaataaccactacagcccatctctgaggaccaggctcaccctnacgagacaccgaccaaaacgnggtcgtacctaacactgaacaacatcggaccccagtcggaacacacgaccctaacacttactactgtcacgacgacgggagtggtacgtgggtgtggactacggtcggggaccgagggacgtccggtacggtccgtacccgtcctccgtccgaccgtaccctacccgaacccggaacgggacccctaacgttcccggttccccgttcccccgtacgggtccccgtcccgtccggcccgtcccgaacgggaccgaccccgtacccggttacccggaacggaccggccgaaccggaccccggg

SEQ ID NO: 71725 - DNA, 581 bp, Homo sapiens
  misc_feature: GYAE6OF01DD7BL.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggaccaccgaccaaaaaccnggtgtcctaacactgaccaaacatcggaaccccatcggaacacacgccacatactactgtcgcacgacgggagtcggctggggtgtcgggactacgtcggggccagggacgtccgtggtccaccgtctcctcgacgccctaccaccgaacgggccctaacgtccggtccttcccccgtggcccgtcccctgcctcccgacgggacgccaccctccggagacgccgacgaccgg

SEQ ID NO: 71726 - DNA, 776 bp, Homo sapiens
  misc_feature: GYAE6OF01ADO37.21.26.C04.1.454.CMB.1.raw
  modified_base (675)..(675): a, c, t, g, unknown or other
  misc_feature (675)..(675): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcaggtgggtggtgggctggactccgtccgaccggacccccggaaacggccccggaggtcggcttcgcactctatttagtggaatgatacgaactaacccactaccacgacccactcgtcgtacggacggaccacggtccctaccaccctacgaaccggaaccggaaccgaaccccgaaacccgaaaaaccgtacgggtaccgtaacctaaaccacgtacgaaacccaacacgtaccgaccctagacggaacacacgaccactactactacgtcgtacgcgaacggtagggtaggtcgggtcggttaggggtacgtacggggtaacctacgggtcggggaccgtacggggactttcccggtacggttcccacccggttcctacccgtaccgacccggtcccctaaccccgaacgggtaacccgggtacccccttacggttccccccgggtttaccccgttccccccgggngggtacccccgtccccggttacgtaccccgcccgggaacgggtaccccaccccgggtacccgtaacccggggagaccccggtaccgcccgggtaccccggg

SEQ ID NO: 71727 - DNA, 575 bp, Homo sapiens
  misc_feature: GYAE6OF01EBD4L.21.26.C04.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacacgcccatctctgaggaccaggctcaccctcacgagacaccgaccaaaacnggtcgtaccaacactgaccaacactcggacccagtcgacacagaccacatactactgtcgcacgacgggagtggcgtgggtgtcgggactacggtcggggaccgagggcgtccgtcggtccaccgtccgtcctcacgtccctccaccgaacgggccctacgtccggtcccttcccccgcggcccgcccgtgcctccgacggcgacccaccgtaccgagacgcgacgaccgg

SEQ ID NO: 71728 - DNA, 594 bp, Homo sapiens
  misc_feature: GYAE6OF01CW7L1.21.26.C04.1.454.CMB.1.raw
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
  modified_base (566)..(566): a, c, t, g, unknown or other
  misc_feature (566)..(566): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgacgaccaggctcaccctnacgaagacaccgaccaaaaaccnggtacgtacctaacactacgaaccaacatcggaaccccagtcggaacacacgaccaacactactactgtacgacacgaacgggagtggtcgtgggtgtgggactacggtggggccgagggacgtccgtggtccaccgtctcctcgacgccctaccgaaccgaacggcccacgtcccggttccctcccccgtggacccgcccgtgcccgtccgacggacnccgacccgtacgagaccgccacgaccgg

SEQ ID NO: 71729 - DNA, 575 bp, Homo sapiens
  misc_feature: GYAE6OF01B3N0T.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcaccctcacgaagacaccgaccaaaaaccnggtcgtcctaacactgaccaacatcggaccccatcggacacagccacatactactgtgccacgacgggagtggctggggtgtgggactacgtggggccagggcgtccgtggtccaccgtctcctcgacgccctccaccgaacgggcccaagtccggttcccttcccccgtggcccgtccccgtgccctccgacggtacgccgacccgtcccgagccgccgacgacggg

SEQ ID NO: 71730 - DNA, 695 bp, Homo sapiens
  misc_feature: GYAE6OF01EZKOJ.21.26.C04.1.454.CMB.1.raw
tcagtcgtcgctcgcacgaccggtgctcgattttagtctagcgactttgggtttgggggggtaagggagggaagactgacggtccttggcctgcgtacgaccagtacccttccatgggtcttgtccctagattccaccctttgaaggacgtctgggtcccacgctggtcgaaacccacagagacctcacgctgacctgcaccttctctcgggttttcactctagttaccacgtgacaggtcgggtgtgggctcggatccgtcgacgcccccggaaaggccccggagtcggtcttcgactactctactttagtacgaatgagtacgaactaaccgactacgacgtaccctacgtcctcgtacggacggaccgtacggcctccacccgtacgaacggaacgacaccgaaccaaaaccgtcggtacgtacctaacgtacgtacgaccgaacgacgtacgaccgtacgtcggacaccgacgaccactactacgtacgtcgacgacacgacggtaggtacggtcgttgggtcgtacggtacgtacggtcgggacgaggtcgtcgtacggtaccgtcgtccgtcctcgaccgtccgtaccgaccgacggtaccgtacggttccggtacccgtcccgtcggtacccgtccgtgtcccgtccgacggaccacccgtaccgtacccgagtaccgccgtcgtccg

SEQ ID NO: 71731 - DNA, 623 bp, Homo sapiens
  misc_feature: GYAE6OF01CTOOY.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtggtgtgggctggatccgtcacgacccccggaaaggccccggagtggcttgcactcatttattggaatgatgataaccactacagccatctctgagaccagctcaccctcacgaacgacaccgaccaaaaccgaggtacgtacctaacactacgaaccaaacactacggaaccccagtacggaacacgagacccaacactaactactgtacgacacgacgggagtcggctgggtgtgggactacgtcggggccgagggacgttccgtggtccaccgttctaccctcgaccgcctaccgaccgtaacgggccctacgtccggttcccttcccccggtggccccgtccccgtgtcccgttcccgacgggaccgacccgtacccgtacccggacgtaccggccaacggacccggg

SEQ ID NO: 71732 - DNA, 599 bp, Homo sapiens
  misc_feature: GYAE6OF01AI98K.21.26.C04.1.454.CMB.1.raw
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
  modified_base (568)..(568): a, c, t, g, unknown or other
  misc_feature (568)..(568): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagccccatctctggacgaccaggcctccaccctcgacgaacggaccaacccgaccaaaaaccgaggtacggtaccctaacactagaacccaacactacggaccccatcggacacacgaccacactactactgtcgacacgacgggagtcggacgtgggtgtacgggactacggtcggggaccagggtcgtccgtggtccaccgtctccncgacgtccnccgaccgacggcccagtccgtccttccccgtggcccgtcccgtgcctcccgacggcncccgaccgtaccgagaccgcgaccgaccggg

SEQ ID NO: 71733 - DNA, 557 bp, Homo sapiens
  misc_feature: GYAE6OF01AZYJ9.21.26.C04.1.454.CMB.1.raw
  modified_base (353)..(353): a, c, t, g, unknown or other
  misc_feature (353)..(353): n is a, c, g, or t
  modified_base (476)..(476): a, c, t, g, unknown or other
  misc_feature (476)..(476): n is a, c, g, or t
  modified_base (513)..(513): a, c, t, g, unknown or other
  misc_feature (513)..(513): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttattggaatgatgataaccactacagcccatctctgaggaccaggcctccaccctcacgaacggacaccgaccaaaaaccnggtcgtacctaacactcgaaccaacatcggaccccatcggacacacgaccacatactactgtgaccacgacgggagtggcgtgggtgtggactaggcgggccagggctcgtggtcacgtctcncgacgccctaccacgacggccagtccgtcctccccgngccctccgtgcctccgaggcgccaccgtccgagcgccacgccgg

SEQ ID NO: 71734 - DNA, 716 bp, Homo sapiens
  misc_feature: GYAE6OF01CY1J1.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtgggctggatccgtcacgaccccggaaaggccccggagtggcttgcactctatttatggaatgatagaataaccactacacgcccatctcgtagacgaccgaggcctccaccctacgaacgaacggacaacccgaaccgaaaaaccgacgggtacggtacctaaccaacgtacgaaccaaacacgtaccggaaccccaagtacgaacaacacgaccaacactaactacgtcgtacgacgaaccggaacgggtaggtacggtccggttggggtacgggtacgggaaccgttacgggtcgggggacccgtagggtaaccgtcccggtaggtacccgtaacccggtccttacccgtcgaaccgtccccgttaaccgaacccggtaaccgggccccttaacggttcccggttccccgtacccccggtcggccccgtcccgtacgaccctccggaaccggcgtacccgaccccgtacggaaccggaccgccgacgtaccccgggg

SEQ ID NO: 71735 - DNA, 610 bp, Homo sapiens
  misc_feature: GYAE6OF01A7WZ2.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacgcccccggaaaggccccggagtggcttgcactcatttatggaatgatgataaccatacagcccatctctgagaccaggctcacctcacgaagacaccgaccaaaaaccgggtgacctaacactcgaccaacactacggacccataggacacagccacatactactcgtagcacaccgggagtcggcgtgggtggtacgggactacgtcggggccaggggtacgttccgtggtccgtacccgtctcccgtacgaccgtccctacccaaccgaacgggcccctaagtcccggttccttcccccgtacggcccgaccccgtcggaccttccggacggacgcccgacccgtccggacgacggtccaccggcggtccccggg

SEQ ID NO: 71736 - DNA, 597 bp, Homo sapiens
  misc_feature: GYAE6OF01D6CUI.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtcggcttgcactcatttatggaatgatgataaccactacagcccatctctgaggaccaggctcaccctcacgaagacaccgaccaaaaaccnggtcgtaccctaacactgaacccaacactacggaccccatcggaacacacgccaacatactactgtcgacacgacgggagtggcgtgggtgtgggactacggtgggccgagggcgtccgtggtccaccgtctacctcacgtccctaccacccgaacgggccctacgtcccggtcccttcccccgtggccccgccccgttcgcccgtcccgacggacgccctaccccgtcgaacggacgccacgacccggg

SEQ ID NO: 71737 - DNA, 584 bp, Homo sapiens
  misc_feature: GYAE6OF01DAOLI.21.26.C04.1.454.CMB.1.raw
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcactctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcaccctcacgagacaccgacaaaaccnggtcgtcctaacnctgaccaaacatcggaaccccatggacacacgccaacatacctatgtgcaacgacgggagtggcgtgggtgtgggactacgtggggccagggcgtccgtggtccaccgtctcctcgacgccctaccgaccgaacgggcccacgtcccggtccttcccccgtgggcccgccccgttgcccttcccgacgggacgtcccgtacccgtaccggagacgccgaaccgacggg

SEQ ID NO: 71738 - DNA, 623 bp, Homo sapiens
  misc_feature: GYAE6OF01BPNJK.21.26.C04.1.454.CMB.1.raw
  modified_base (343)..(343): a, c, t, g, unknown or other
  misc_feature (343)..(343): n is a, c, g, or t
  modified_base (612)..(612): a, c, t, g, unknown or other
  misc_feature (612)..(612): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggcctcacctcacgaagcacgaccaaaaacngtcgacctaacactcgaaccaacactcggaccccatggaacacgacgccaacactactaactgtacgcaacgaacgggagtcgggactggggtgtggggacttaacggtgggggtcccgaaggggtacgtcccgttgggtaccctaccggttcctacccgtccacgtccccttaccgaacccgtaacgggccccaacgtccggtccctttacccccgtggtacccgcccgtgccctcccgaacgggacacccgtacccgtccggaagcncgacgaccggg

SEQ ID NO: 71739 - DNA, 566 bp, Homo sapiens
  misc_feature: GYAE6OF01ADX2N.21.26.C04.1.454.CMB.1.raw
  modified_base (345)..(345): a, c, t, g, unknown or other
  misc_feature (345)..(345): n is a, c, g, or t
  modified_base (518)..(518): a, c, t, g, unknown or other
  misc_feature (518)..(518): n is a, c, g, or t
  modified_base (558)..(558): a, c, t, g, unknown or other
  misc_feature (558)..(558): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcaccctcacgaagacaccgaccaaaaccnggtcgtacctaacactcgaccaacatcggaccccatggacacagccacatactactgtcgcacgacgggagtggcgtggggtgtgggactacggtcggggccgagggcgtccgtcggtccgaccgtctccctcgacgtcctccaccgaacggcccagtccgtccttcccccgnggcccgtcccgtgcctccgacggcgccgaccctccgagcncgcgccgg

SEQ ID NO: 71740 - DNA, 582 bp, Homo sapiens
  misc_feature: GYAE6OF01A7LEL.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggacaccgaccaaaaaccnggtcggtacctaacactcgaccaacatcggaccccatcggacacacgaccacactactactgtcgaccacgacgggagtggcgtgggtgtcgggactacggtggggccgagggcgtccgtggtcaccgtctcctcgacgccctccaccgacgggcccagtccggtcctcccccgtggcccgtcccgtgccgtcccgacggacgacctacccgtccgaggacgcaccgaccggg

SEQ ID NO: 71741 - DNA, 585 bp, Homo sapiens
  misc_feature: GYAE6OF01AVXI7.21.26.C04.1.454.CMB.1.raw
  modified_base (346)..(346): a, c, t, g, unknown or other
  misc_feature (346)..(346): n is a, c, g, or t
  modified_base (413)..(413): a, c, t, g, unknown or other
  misc_feature (413)..(413): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcacctcacgaaggacaccgaccaaaaaccnggtcggtacctaacactagaccaacactacggaccccagtcggaacacagaccacatactactgtcncacgacgggagtggcgtgggtcgtgggacgtacgtcggggccaggggtagtccgtggtccaccgtctcccgtcacgtccctccaccgaacgggcccagtcccggtccttcccccgtggcccgccctgccgtccgacggcgaccgacccgtccggagccgccgacgacccggg

SEQ ID NO: 71742 - DNA, 620 bp, Homo sapiens
  misc_feature: GYAE6OF01D43QJ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtcggcttcgcactctatttatggaatgatgactaaccactacagccatctctgacggaccaggcctcaccctcacgaacgaccacccgaaccaaaaccgaggtcggtacctaacactacgaaccaacgataccggaccccagtacggacacgacgccactactactactgtacgacacgacggagtcggcgtgggtaggtcggacgtcggtacgggccgtagggcgtccgtcggtccaccgtctacctcgaccgtccctaccgaccgaacggccctacgtccggtccttccccgcggtcccgtcccgtcgccgtcccgacggaccgaccccgtacctacggacgacggtcccgacgtacccggg

SEQ ID NO: 71743 - DNA, 586 bp, Homo sapiens
  misc_feature: GYAE6OF01CB64D.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgacggaccaggctcaccctcacgaacggaccaacccgaccaaaaaccgaggtcggtacctaacactacgaaccaacactcggaacccccatcggacacacgaccacatactactgtcgcacgacgggagtggcgtgggtgtgggactacgtcggggccagggacgtccgtggtccaccgtctcctcacgtccctaccgaccgaacgggccctacgtccggtccttcccgtcgtcggccgtcccgtgcccgtccgacggcgcccaccgtaccgacgcgcgacg

SEQ ID NO: 71744 - DNA, 562 bp, Homo sapiens
  misc_feature: GYAE6OF01BT6N6.21.26.C04.1.454.CMB.1.raw
  modified_base (350)..(350): a, c, t, g, unknown or other
  misc_feature (350)..(350): n is a, c, g, or t
  modified_base (513)..(513): a, c, t, g, unknown or other
  misc_feature (513)..(513): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggaccaccgacccaaaaacnggtaggtacctaacactgaaccaacatcggaccccatggacacacgccacatactactgtgacacgacgggagtggcgtgggtgtgggactacgtggggccagggactcgtggtcaccgtctcctcacgtcctccaccacggcccagtccggtccttccccgnggccgccctcgcctccgacggacgcctacccgtccgagcgcgcgaccgg

SEQ ID NO: 71745 - DNA, 611 bp, Homo sapiens
  misc_feature: GYAE6OF01D2B2D.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgacccccggaaggccccggagtggcttgcactcatttatggaatgatgataaccactacagccatctctgaggaccaggcctcaccctcacgaagacaccgacaaaaaccaggtcgtacctaacactagaaccaacagtcggaccccaagtcggacacacgacccaacacttaactactgtacgccaacgacggggagtgggcggttggggtgtcgggacgtacggtcggggccgaggggcgttcgtcggtccaccgtcctcctcgacgtccctacccgaccgaacgggcccacgttccggttcccttcccccgtggcccgtcccgtgccctccgacggacacccgtaccgtaccggacgacgccgaacgacccggg

SEQ ID NO: 71746 - DNA, 601 bp, Homo sapiens
  misc_feature: GYAE6OF01EA7Q6.21.26.C04.1.454.CMB.1.raw
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (581)..(581): a, c, t, g, unknown or other
  misc_feature (581)..(581): n is a, c, g, or t
  modified_base (594)..(594): a, c, t, g, unknown or other
  misc_feature (594)..(594): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacacgcccatctctgaggaccaggctcaccctcacgaagacaccgacaaaacngtgaccacacngacaanatcgacccatcggacacacgccaacactaactactgtacgaccaacgacgggaacggtgggtcgtgggggttacggtacgggaccgttaacggttcgggggacccgaaggggtaccgttccgtcggtaccctacccggtcctccgtaccgacgtccctacccgaccgaacgggccctacgtccgtccttccccgtgccgccctgcctccgagcgaccnccgtaccgagacncagccgg

SEQ ID NO: 71747 - DNA, 621 bp, Homo sapiens
  misc_feature: GYAE6OF01A7WYM.21.26.C04.1.454.CMB.1.raw
  modified_base (353)..(353): a, c, t, g, unknown or other
  misc_feature (353)..(353): n is a, c, g, or t
  modified_base (553)..(553): a, c, t, g, unknown or other
  misc_feature (553)..(553): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcagccccccggaaaggccccggagtggcttgcactcatttatggaatgatgataaccactacagcccatctctgaggaccaggcctacaccctcaacgaaggaccaacccgaccaaaaaccngggtcggtacctaaacactagaaccaacagtcggaaccccagtcggacacacgccaacatactactgtacgacaccgacgggagtcggcgtgggtcggtgggactacggtcggggaccgagggtacgtcgtggtaccgaccgtcctccgtcgacgccctaccgaccgaaccggccctacgtcccggtaccttccccccgnggtacccgccccgtgccctcccgacggacgacccgtacccgtaccggacgacgcccgacgtacccggg

SEQ ID NO: 71748 - DNA, 604 bp, Homo sapiens
  misc_feature: GYAE6OF01BZYCA.21.26.C04.1.454.CMB.1.raw
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (577)..(577): a, c, t, g, unknown or other
  misc_feature (577)..(577): n is a, c, g, or t
  modified_base (593)..(593): a, c, t, g, unknown or other
  misc_feature (593)..(593): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgaactaaccactacagcccatctctgacggaccaggcctcaccctnacgaagacaccgaccaaaacnggtcgtacctaacnctacgaccaacactcggaaccccatcggaacacacgaccaacatactactgtcgacacgacgggagtggacgtgggtggtacgggacgttacggtcggggaccgaggggtacgttccgttcggtaccacccgttcctacccgtcacgcccctaccgacctacgggcccagttcccggtccttcccccgtggccgcccctgccctaccgaggaccncctacccgacgagacnccgacgaccgg

SEQ ID NO: 71749 - DNA, 719 bp, Homo sapiens
  misc_feature: GYAE6OF01BFHPV.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtggtgggctggactccgtcacgacccccggaaaggccccggagtggcttgcactctatttatggaatgatgactaaccactacacgccctatctctagacggaccaggcctccaccctacgaacggaacggaccaaccgaaccaaaacgacggtacggtacctaacactacgaaccaacacgtcgaaccccagtacgacacgacgaccacactactacgtgtacgaccgacgacgggaggtcggacggtgggtacgggtacgggtacgtacgggtcggggaccgtaggggtaccgtccgtacggtaccgtacccgttccgttacccgtaccgaccggtacccctacccgaacccggtaacccgggtccctaaccggtcccggttacccccgtttcccccggtccgggtacccccggtcccgttcgtaccccggttcccgaccgggtaccgtacccgtaccccggttacccggaacggaccggaccgtaccggaaccccgggg

SEQ ID NO: 71750 - DNA, 581 bp, Homo sapiens
  misc_feature: GYAE6OF01A507S.21.26.C04.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccatacagcccatctctgagaccaggctcacctcacgagcaccgaccaaaacnggtgcctaacactagaccaacatggaccccatggacacagccacatactactgtgccaacgacgggaagtggacgtggggtcgtaggggactaacgtgggggcccaggggacgtccgtgggtccaccgttctccctcacgtccctccgaaccgaacgggcccagtcccgggtccttccccccgtgggcccgtccccgtgcctcccgacgggcgcctacccgtcccgaggcgccacgaccggg

SEQ ID NO: 71751 - DNA, 602 bp, Homo sapiens
  misc_feature: GYAE6OF01D7X6E.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatcctctgaggaccaggctcaccctcacgaagacaccgaccaaaaccaggtgacctaacactcgaaccaacatcggaccccagtcgacacagccacatactactgtgacacgacgggagtggcgtggggtcgtgggacgtacggtggggccgagggacgtaccgtcggtccaccggttcctccctccgacgtcccttaccgacccgaacgggcccacgttcccggtcccttcccccgtggcccgtccccgtgcccgtccgacgggaccacccgtacccgtaccggacgacgccgacggaccgg

SEQ ID NO: 71752 - DNA, 559 bp, Homo sapiens
  misc_feature: GYAE6OF01DX6VB.21.26.C04.1.454.CMB.1.raw
  modified_base (346)..(346): a, c, t, g, unknown or other
  misc_feature (346)..(346): n is a, c, g, or t
  modified_base (454)..(454): a, c, t, g, unknown or other
  misc_feature (454)..(454): n is a, c, g, or t
  modified_base (534)..(534): a, c, t, g, unknown or other
  misc_feature (534)..(534): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccatacagcccatctctgaggaccaggctcaccctcacgaagacaccgaccaaaaaccnggtcggtcctaacactgaaccaacatcggaccccatacggacacacgccaacatactactgtgcacgacgggagtggcgtgggtgtagggactacgtggggccagggngtccgtggtccaccgtctcctcgacgcctccacgaacggcccagtccgtcctccccgtggccgccctgcctccgacggcnccgacctaccgagcgcacgaccggg

SEQ ID NO: 71753 - DNA, 698 bp, Homo sapiens
  misc_feature: GYAE6OF01APXJP.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttggtttgggggtaaggaggaaggacgtgacggtccgtgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccgggaaagccccggagtggcttgcactcattattggaatgatgataaccactacagcccatctctgaggaccaggcctcaccctcacgaacggacaccgaccaaaaaccnggtacgtccgtaaaccactacgaacaacatcggaccccatggaacacaacgccaacacgtactaacctgtagccaacgaccggggaattcggacggtcgggttagggtcgggaacccgttaaggtcgggggaccccgaaggggtaccgtcccggttagggtccccgaaccggttcccgttacccgttaccgaaggtcccccctacccgtaacccggtaaacgggggccccctaaaggttcccggttcccttacccccccccgggtggtacccggtccccctgggcccctaccggtaaccggcggaacccctacccgtcccggaaggaccgtccgaccctaacgggg

SEQ ID NO: 71754 - DNA, 847 bp, Homo sapiens
  misc_feature: GYAE6OF01EPJMB.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttggttttcactcagtaccactgcaggtgggtgtgggctggactccgtcaccggacccccggaaaggccccggagtcggcttcgcactctatttagtggaatgatgactaaccactacacgcctatctcgtggacggaccgacggtcctaccaccctacgaaccggaacggaaccgaacccgaaaccgaaaaaccgtacggtacggtaacctaaccgactacgaaaccaacgtacgtaccggaaccccagtacgaacgaaccgtacgaccaacgtactaacgttaccgtggtaccgaaccgaccggtaacggggtacgtcgggtaccgttagggggtcgggtaaccgggtacctaacggggttccggggacccgtaacggggtaccgttcccggttacgggtaccccgaacccggtttccttaccccggtaccgacccgtacccccgttaacccggaacccgggtaaccccggggttaccccgtaacccggtttcccgggttacccccctttacccccccggggtacgggttccccccgttccccgggttaacccggtcccccggttaaccccgggaaacggggaaccccgttaccccggtaacccccggttaacccgggaacggttaaccccgaacccggtacccgggtaacccccggggg

SEQ ID NO: 71755 - DNA, 584 bp, Homo sapiens
  misc_feature: GYAE6OF01C48G0.21.26.C04.1.454.CMB.1.raw
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (394)..(394): a, c, t, g, unknown or other
  misc_feature (394)..(394): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgcacgcccccggaaaggccccggagtggcttgcactcatttattggaatgatgataaccactacagcccatctctgacgaccaggctcaccctcacgaggacaccgacaaaacngngtcaacnctgacaacatcgacccatgacacacgccacatactactgtcncaacgacgggagtggcgtgggtgtgggactacggtcggggccgagggcgtccgtggtccaccggtctccgtcgacgccctaccaccgacgggccctacgttcccggttcccgttcccccgtggcccgtccccgtagtccctcccgacgggaccgccgtaccccgtaccggagaccgccgtacgacccggg

SEQ ID NO: 71756 - DNA, 654 bp, Homo sapiens
  misc_feature: GYAE6OF01CP53R.21.26.C04.1.454.CMB.1.raw
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagacgaccctcacgctgacctgcaccttctcgtggttttcactcacgtaccactgcaggtgggtggtggctggactccgacgaccggacccccggaaaggccccggagtggtcttgcactctatttagttggaatgatgaactaaccactacacgcccatctctacggacgaccgacggaccttccaaccccgtacgaacggaaaccggaccaaaccccgaaaccgtaaaaaccgtagggtaccgtaacctaaccgaactacgaaccaaacacgtacggacccagacggacacacgacacatactatcgancacgagggngtaggcggtgggtcgaggaacctaggtcggggacgtaggaccgtcgtggtaccctaccggtctaccacgaccgtacccgtaccgacgtaaccggcccctacgtttcccggccccttacccgcggacccgtccgtcgcctaccggagccgtaccaccgcgaaggccacgccgaccggg

SEQ ID NO: 71757 - DNA, 566 bp, Homo sapiens
  misc_feature: GYAE6OF01ENZ4M.21.26.C04.1.454.CMB.1.raw
  modified_base (516)..(516): a, c, t, g, unknown or other
  misc_feature (516)..(516): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatggatgataaccactacagcccatctctgaggaccaggctcaccctcacgaagacaccgaccaaaaaccaggtcggtacctaacactgaccaacatcggaccccatcggacacacgccacatactactgtacgcacgacgggagtcggcgtgggtgtgggactacgtggggccagggacgtccgtggtccaccgtctcctcgacgcctccaccgacggcccagtccgtcctccccgnggccgtccctgcctccgacggacgcccgacctccggagcgcgcgaccggg

SEQ ID NO: 71758 - DNA, 642 bp, Homo sapiens
  misc_feature: GYAE6OF01D6GZU.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtgcttgcactcatttatgaatgatgactaaccactacacgcccatctctgacggaccaggcctcaccctcacgaacggacaaccgaccaaaaaccgaggtcgtacctaacactacgaacaaacacgtacggaaccccagtcggaaccacagcccaacattactactgtcgacctaacgacgggagtggcgtggggtggtcgggacttacggtcggggaccgtaggggtcgtccgtcggtcccgaccgttcctccgtaccgacgtcccctacccgaaccgaaccgggcccctacgttcccggttaccttccccccgtggtcccgtcccccgtgccccgtccgacgggaccgacccgtacccgtacccgaagaccgcccgacgaccggg

SEQ ID NO: 71759 - DNA, 710 bp, Homo sapiens
  misc_feature: GYAE6OF01AFKVY.21.26.C04.1.454.CMB.1.raw
  modified_base (652)..(652): a, c, t, g, unknown or other
  misc_feature (652)..(652): n is a, c, g, or t
tcagtcgtcgctcgcacgaccggtgctcgatttagtctagcgactttgggtttggggggtaaggaggaagactgacggtcctgctgctgaccatcccttcatgggtcttgtcccagatcaccttgaaggagtctggtcccacgctggtgaaacccacagagaccctcacgctcgacctgcaccttctcgtgggttttcactcagtaccactgcagtgggtgtgggctggatccgtcacgcccccggaaaggccccggagtggcttgcactcatttatggaatgatgataaccactacagcccatctctggacggaccaggcctaccgaccctacgaacggaacggaccaacccgaacccaaaaaaccgtgggtcgtaacctaaaccaccgtgaaacccaacacgtccgggaacccccagtacgggaaccaaaccgacgtaccccaaacgtacgttaacccttacgtacgttacgaccgtaaccggacggggtaacggttcgggtaaccggttgggggtacggtacggggaaccgttaccgggtacgggggccgtaaacggggtcggttacccgttggacccggttaccgtcctcccgttacgaccggtcctacccgacccgaacgggccctacgtcccggtccgttccccgnggcccgccgtcgcctccgacggcgcccgtacccgtacgacggtacgccgaccgacggg

SEQ ID NO: 71760 - DNA, 564 bp, Homo sapiens
  misc_feature: GYAE6OF01B12FZ.21.26.C04.1.454.CMB.1.raw
  modified_base (346)..(346): a, c, t, g, unknown or other
  misc_feature (346)..(346): n is a, c, g, or t
  modified_base (516)..(516): a, c, t, g, unknown or other
  misc_feature (516)..(516): n is a, c, g, or t
  modified_base (538)..(538): a, c, t, g, unknown or other
  misc_feature (538)..(538): n is a, c, g, or t
  modified_base (557)..(557): a, c, t, g, unknown or other
  misc_feature (557)..(557): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgagaccaggctcaccctcacgaaggacaccgaccaaaaaccnggtcggtacctaacactgaaccaacatcggaccccatggacacagccacatactactgtcgcacgacgggagtggcgtggggtgtgggactacgtggggccaggggtcgtccgtggtccaccgtctccctcgacgtccctccaccgacggcccagtccggtctcccccgnggccgccctgcctccaggtacnccgtaccgtccgagcgccncgaccgg

SEQ ID NO: 71761 - DNA, 594 bp, Homo sapiens
  misc_feature: GYAE6OF01CJUA8.21.26.C04.1.454.CMB.1.raw
  modified_base (359)..(359): a, c, t, g, unknown or other
  misc_feature (359)..(359): n is a, c, g, or t
  modified_base (541)..(541): a, c, t, g, unknown or other
  misc_feature (541)..(541): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggcctcacccctcgaaccgaacggaccaacccgaccaaaaaaccgngggtacggtccctaaacgactacgaaccctaaacactacgggacccccagtcggaacacacgccacactactactgtcgcacgacgggagtggcgtgggtgtgggactacgtggggccagggacgtcgtggtccacgtctccgtcacgcctccaccgacggcccagtccggtccttccccgnggcccgtccctgcctcccgacggcgcccgtaccgtccgagaccgcgcgaccgg

SEQ ID NO: 71762 - DNA, 649 bp, Homo sapiens
  misc_feature: GYAE6OF01ANRDY.21.26.C04.1.454.CMB.1.raw
  modified_base (351)..(351): a, c, t, g, unknown or other
  misc_feature (351)..(351): n is a, c, g, or t
  modified_base (424)..(424): a, c, t, g, unknown or other
  misc_feature (424)..(424): n is a, c, g, or t
tcagtcgtcgctcgcacgaccggtgctcgatttagtctagcgactttgggtttggggggaagaggaagactgacggtcctgctgctgaccatacccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggaccaccgaccaaaaaccnggtcgtacctaacactcgaaccaacatcggacccagtcggacacacgccacatactactgtgacacgacgggngtggcgtgggtagtcgggactacgtggggaccagggtactcgtggtacctaccgtcctacccgtcaccggtaccctacccgaaccgaaccggggtaccccacggttcccggtcccgtttccccccggagggtccccggtccccgttacggccccgttacccggaaccgggtaccgcccgtaaccccgttaccccgggaagacccggtaccgaaccggtacccggg

SEQ ID NO: 71763 - DNA, 612 bp, Homo sapiens
  misc_feature: GYAE6OF01DUCC6.21.26.C04.1.454.CMB.1.raw
  modified_base (300)..(300): a, c, t, g, unknown or other
  misc_feature (300)..(300): n is a, c, g, or t
  modified_base (349)..(349): a, c, t, g, unknown or other
  misc_feature (349)..(349): n is a, c, g, or t
  modified_base (550)..(550): a, c, t, g, unknown or other
  misc_feature (550)..(550): n is a, c, g, or t
tcagtcgtcgctcgcacgaccggtgctcgatttagtctagcgactttgggtttggggggaagaggaagacgtgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtcggcttgcactcattttattggaatgatgataaccactacacnccatcctctgacgacaggctcaccctcacgacgacaccgaccaaaacgnggtcgtacctaacgactacgaccaacactcggaccccagtcgaacacacgaccaacaactactactcgtacgacgaacgacgggagtcggcgtaggggtacggtgggaacgtacggtcgggaccgagggcgttaccgtggtcctaccgtctcctacacgtcctccgacgaccggccctaagttcccggtaccttcccccgnggtcccgtcccgtagccgtcccgaggacgacccgtacccgacggagaccgcgaccgaccggg

SEQ ID NO: 71764 - DNA, 615 bp, Homo sapiens
  misc_feature: GYAE6OF01D6AEJ.21.26.C04.1.454.CMB.1.raw
  modified_base (603)..(603): a, c, t, g, unknown or other
  misc_feature (603)..(603): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactaacacgcccatctctgacggaccaggcctcaccctcacgaacgaccaccgaaccaaaaaccaggtcggtacctaaacactacgaaccaaacatcggaaccccatcggacacgacgccaacatactatcgtagcacgacgggagtggcgtggggtgtacgggactacggtcggggaccgaggggtacgtccgtcggtaccctaccggttcctcctccgacgtccctaccacccgaacgggcccagtcccgtcccgttcccccgtcggcccgtcccctggcctccgaggaccgaccctacccgtacccgagacncgaccgtacggg

SEQ ID NO: 71765 - DNA, 581 bp, Homo sapiens
  misc_feature: GYAE6OF01ECMDY.21.26.C04.1.454.CMB.1.raw
  modified_base (556)..(556): a, c, t, g, unknown or other
  misc_feature (556)..(556): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccaggtggtcctaacactgaaccaacatggaccccatggacacagccacactactactgtgcacgacgggagtggcgtggggtgtgggactacgtcggggccaggggtacgtccgtgggtcctaccggtcctccctcgacgtccctacccacccgaacgggccccactccgggtacccttcccccgtggcccgcccctggcctccgaggcnccgtacctaccgagcgcgacgacgg

SEQ ID NO: 71766 - DNA, 700 bp, Homo sapiens
  misc_feature: GYAE6OF01DKKTB.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggactccgtcgacgccccccgggaaacggccccggagtcggtcttgccactctattttataggaatgatagaataaaccactacacgccatctctgacggaccaggcctccaccctacgacgaacggaccaacccgaaccaaaaaccgaggtacgtacctaacactacgaaccaaacacgtaccggaaccccagtacggaacaaccacgaaccaactaactaccgttacgtgtacgaccgaccgaacgggacggtgggtcggttggggtgtacggggtactcgggtcggggaccgagggtcgtacccggtggtccctaccggtccttaccgacgtaccgcccgtaccacccggaaccggtccctacgttcccggttccccttcccccggtcggtccccgtaccccgtcggacccgttcccggaaggtacccgacccgtacccggtaccggacgaccgccgaaccggtacccgggg

SEQ ID NO: 71767 - DNA, 683 bp, Homo sapiens
  misc_feature: GYAE6OF01C4ZK6.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgaataaccactacacgcccatctcgtagacggaccaacggctccaccctcaacgaaggaccaaccgaaccaaaaccgaggtcgtacctaacactacgaacaacactacggacccatgacacgacgccacactactacgtagtcgcgaacgacgggagtcggtcgtgggttggtacgggacgtacggtcggggaccgaggggtacgttccggtcggtaccgacccggttctaccccgtcgaccggtcccgttcccgaaacccgtaaccgggccccctaacgttccccgggttcccgtttacccccccggtgggcccccgtcccctcggtacccgttacccggaacgggaccctacccgtaacccgtaccccggaaggacccggcctaacccggacccgggg

SEQ ID NO: 71768 - DNA, 756 bp, Homo sapiens
  misc_feature: GYAE6OF01CZNVR.21.26.C04.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccagctggtgaaacccacagagaccctcacgctgacctgcaccttctctgggttttcactcagtaccactgcagtgggtggtgggctggatccgtcgaccgacccccggaaaggccccggagtggccttgcactcatttattggaatgatagactaaccactacacgcccatctctagacggaccaggctccaccnacgacgacacgacaaaacnggngtacaacactcgacaacgactcgacccatacggacacacgtaccaactaactaaccttacgtcgtacgacgaaccggtaccggggtaggcggttaccggtgggggttagggttacggggtaaccttaccggggtacgggggtacccgaagggggtaccgttcccggttacgggtacccgttaaccccggttcctaccccggtaccccgtaaccgggtaccccccttaaccccggaacccgggaaaccgggtcccccgttacggttacccccggggtttcccccttccccccgggtcccgggaccccggttcccccgtaccggtccccgttaccccgggacgggtaaccgacccccgttacccggtacccgaacggtacccggacccgtaacggacccccgggg

SEQ ID NO: 71769 - DNA, 606 bp, Homo sapiens
  misc_feature: GYAE6OF01BJ57U.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttatggaatgatgataaccactacagccatctctgaggaccaggcctcaccctcacgaaggaccaccgaccaaaaaccaggtacggtccctaacactgaccaaacatggaccccatcggacacagccacatactactgtgacacacgggagtggctgggtgtgggactacgtcggggccgagggacgtccgtggtccgtacccggtctcctcgacgtcccgtccaacccgaacgggccccacgtccggtacccttcccccgtcgggtacccgccccgtcgcccgtccccgagggaccgacccgtacccgtcccggaaggacgtcccgaccgacccggg

SEQ ID NO: 71770 - DNA, 733 bp, Homo sapiens
  misc_feature: GYAE6OF01CEOVA.21.26.C04.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacggacccccggaaaggccccggagtcggcttcgcactctattttacgttggaatggatgataaccactacagccatctctgacgaccaggcctcaccctcacgaacgaccaccgaccaaaaccgnggtacggtacctaaacgacctacgaacccaaacgacgtacggaaccccaagtcggaaccaccgaacgaccaactaacgtaccttacgtcgtacgacctaccggaacggggtacgtgggtccggttagggggtcggtacggggtaccgttaacggtcggggggacccgtaaggggtaccgttcccggtgggttacccgtacccggttccgttcccgtacgacccgtacccgttacccgaaccggtaaccgggcccctaaccggttcccgttccccgtttcccccggtacgggtccccgtcccgtaccggtcccgtacccggaacggcccgacccgtacccgtaccggaacgacgtcccgaacccggtacccgggg

SEQ ID NO: 71771 - DNA, 713 bp, Homo sapiens
  misc_feature: GYAE6OF01B34YY.21.26.C04.1.454.CMB.1.raw
  modified_base (342)..(342): a, c, t, g, unknown or other
  misc_feature (342)..(342): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgagaccagctcacctcacgaagacaccgacaaaaccgngtacgtactaacactacgaaccaacactcggaaccccagtacggaacacacgaccaacactaactactagtcgacaaccgacgggtagtacggcgtagggtggtgggactacggtggggacccgaggggtacgtcgtcggtaccgtacccgttcgtaccccgttacgaccgtaccccgttaccccgaacccgtaaccggggtaccccctaacggtttccccgggttccccgttttacccccccgggtcggggtaccccccgggttacccccgttccggtaccccgttacccccggaaccggggtacccggaccccgtaacccccggttaccccggaagggacccggtaccccgaaccgggtaccccggggg

SEQ ID NO: 71772 - DNA, 567 bp, Homo sapiens
  misc_feature: GYAE6OF01EJY57.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgacggaccaggcctcaccctcacgaagacaccgaccaaaaacnggtcgtacctaacactgaaccaacatcgaccccatcggacacagccacatactactgtgcacgacgggagtggcgtgggtgtagggactacgtgggccagggcgtccgtggtcaccgtctcctcacgcctaccgaccgaacgggcccagtccggtccttcccccgtggcccgtcccgtgcctccgacggacgcccgaccctaccgagacgccacgaccgg

SEQ ID NO: 71773 - DNA, 605 bp, Homo sapiens
  misc_feature: GYAE6OF01C3YZQ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacgcccccggaaaggccccggagtggcttgcactcatttattggaatgatagataaccactacacgcccatctctagacgaccaggctaccaccctcaacgaaggaccaaccgaaccaaaaaccgaggtacgtactaaaccactacgaaccaaacactacggaaccccagtacggaacacacgaccaacaactactactgtcgacacgacggagtggtcgtgggtggtaggacgtacgtcgggccgacgggacgtcgtcgtccgtaccgtcctcctacacgcctaccaccaacggggggaccacgtccgtccgttccccgtcggcccgcccgtcgcgccgacgacgacctacccgacgacgacgcgacgaccgg

SEQ ID NO: 71774 - DNA, 634 bp, Homo sapiens
  misc_feature: GYAE6OF01B1RIQ.21.26.C04.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggctgcactcatttatggaatgatgataaccactacagcccatctctgaggaccaggctcaccctcacgaaggacaccgaccaaaacnggtcgtacctaacactcgaacaacactacggaccccagtacggaacacacgaccaacatactactgtacgacacgacgggagtcggcgtgggtcggtagggacctacggtcggggacctaggggacgttccgtggtacccaccgtcctaccaccgacgcccctaccgaaccgtaaccgggcccctacgttccggttcccgttccccccgtgggccccgtccccgtggcccgttcccggacgggaccgcccgtaaccccgtccggaacgtaccgccgtaaccggacccgggg

SEQ ID NO: 71775 - DNA, 567 bp, Homo sapiens
  misc_feature: GYAE6OF01B2C26.21.26.C04.1.454.CMB.1.raw
  modified_base (348)..(348): a, c, t, g, unknown or other
  misc_feature (348)..(348): n is a, c, g, or t
  modified_base (560)..(560): a, c, t, g, unknown or other
  misc_feature (560)..(560): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgaggaccaggctcacctcacgaaggaccacccgaccaaaaaccnggtcggtacctaacactcgaaccaacactcggaccccatcggacacacgccacactactactgtgaccacgacgggagtggcgtgggtgtgggactacgtggggccagggcgtccgtgtccaccgtctcctcacgcctccaccgacggcccacgtccggtcctcccccgtggcccgccctcgcctccgacggacgccaccgtccgagacgcncgaccgg

SEQ ID NO: 71776 - DNA, 620 bp, Homo sapiens
  misc_feature: GYAE6OF01BYP4N.21.26.C04.1.454.CMB.1.raw
  modified_base (350)..(350): a, c, t, g, unknown or other
  misc_feature (350)..(350): n is a, c, g, or t
  modified_base (437)..(437): a, c, t, g, unknown or other
  misc_feature (437)..(437): n is a, c, g, or t
  modified_base (609)..(609): a, c, t, g, unknown or other
  misc_feature (609)..(609): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttatggaatgatgataaccactacacgcccatctctgaggaccaggcctcaccctcacgaacggaccaccgaccaaaaaccnggtacggtcctaacactacgaccaaacactacggacccccagtcggacacgacgccaacactaactactgtacgaccacgacggggngtcggcgtggggtgtcgggacttaacgtgggggacccaaggggtacgttccgtcgggtcctaacccggtcttcccgtcgaccgtcctacccgacccgaacgggcccctagtcccggtccttcccccgtgggcccgtccctgcctcccgaggaccgccgaccctccgagaccnccacgacccgg

SEQ ID NO: 71777 - DNA, 620 bp, Homo sapiens
  misc_feature: GYAE6OF01C5OXM.21.26.C04.1.454.CMB.1.raw
  modified_base (588)..(588): a, c, t, g, unknown or other
  misc_feature (588)..(588): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgacggaccaggctcaccctcacgaacggaccaaccgaccaaaaaccaggtcgtacctaaacactagaaccaacactcggaccccagtacggaaccacaacgccaacgataactactagtcgcgaacgacgggagtggcgtgggtggtacgggacgtacggtcgggaccgagggacgtccgtcggtccgaccgttcgtccctcgacgtccctccaaccgaacggccctaacgtcccggttaccgtcccccgtacggtcccgccccgtgtcccgtccgacgggacncccgtacccgtccgagacgccgacgtaccggg

SEQ ID NO: 71778 - DNA, 624 bp, Homo sapiens
  misc_feature: GYAE6OF01A4WP9.21.26.C04.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgccccccggaaaggccccggagtcggcttgcactctatttattggaatgatgactaaccactacagcccatctctgacggaccaggctcaccctcaacgaacgacaccgaccaaaaaccgnggtcggtacctaacactacgaaccaacactcgaccccatcggacacgagccacactactactgtcacacgacgggagtcggcgtgggtcggtgggacgtacggtggggaccgaggggacgtccgtcgggtcccaccggttcctccgtccgacgtccctacccaaccgaacgggacccacgtccggttacccttccccggtcggcccggcccttccgcccgttccgacggacgcccgaccccgtaccggagacgccgacgtacccgggg

SEQ ID NO: 71779 - DNA, 619 bp, Homo sapiens
  misc_feature: GYAE6OF01D2XIM.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgaggaccaggcctcaccctcacgaagacaccgaccaaaaaccgnggtacgtacctaacactacgaaccaaacatacggacccccagtcggaacacacgccaacactactactgtcgacaacgacgggagtggcgtgggtcgtagggactacggtcggggccgaggggcgttccgtggacctaccggtctacccgtcgacgtccctaccaaccgaacgggccccacgtcccggttcccttcccccggtggtcccgtccccgtggccctccggacggacgcccgtacccgtaccggaacgaccgccgaacgaccggg

SEQ ID NO: 71780 - DNA, 618 bp, Homo sapiens
  misc_feature: GYAE6OF01EX4DQ.21.26.C04.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcacgccccccggaaaggccccggagtggcttgcactctatttatggaatgatgataaccactacagcccatctctgacggaccaggcctcaccctcacgaacgacaccgaccaaaaacnggtacgtacctaacactgaaccaacactcggaccccatcggaacaccgagaccacaactacctacgtgtcgacaacgacgggacgtggcgtggggtgtcggacgtacgcggggccgagggtcgtccgtacggtccgaccgttcgtcctcgacgccccgtaccgacccgaacgggtccctacgtcccggtcccttcccccgcgggcccgtccccgtgccccgtccgacggacgccctacccggaccgagaccgtccaccggtaccggg

SEQ ID NO: 71781 - DNA, 609 bp, Homo sapiens
  misc_feature: GYAE6OF01APPNF.21.26.C04.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttatggaatgatgataaccactacagcccatctctgaggaccaggctcaccctcacgaagacaccgaccaaaaaccgnggtcgtacctaacactagaaccaacactcggaccccatcggacacacgccaacatactactgtcgcacgacgggagtggcgtgggtcgtggactacgtgggccgagggacgtccgtcggtcgaccgtctccctcgacgtccctaccgaccgtaacggccctagttcccggtacccttccccccgagggtcccgtacccgtcgcccgttccggacggtacccgaccgtaccccgttaccggacgaccgccgtaaccggacccggg

SEQ ID NO: 71782 - DNA, 631 bp, Homo sapiens
  misc_feature: GYAE6OF01DVRF5.21.26.C04.1.454.CMB.1.raw
  modified_base (303)..(303): a, c, t, g, unknown or other
  misc_feature (303)..(303): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctgggatccgtcacgcccccggaaaggccccggagtggcttgcatcatttatggaatgatgataaccactacagccatctcngacgaccagctcgaccctnacgagacaccgacctaaaacnggtcgtacctaacnctagaccaacatacggaaccccagtcggaacacacgccaacataactactgtacgccaacgtagggacgtggtcgtggggtcgtgggtacctacggtcggggaccagggtacgtccgtggtcctaacccggtctaccccgttacaccgtccctacccgaacgaacggggcccctaacggttcccggttcccttcccccgtggccccgtcccgtcggtcctacccgaacgggtcacccgacccttacccggagaaccggccgaaaccgcccgggg

SEQ ID NO: 71783 - DNA, 621 bp, Homo sapiens
  misc_feature: GYAE6OF01DO2T2.21.26.C04.1.454.CMB.1.raw
  modified_base (345)..(345): a, c, t, g, unknown or other
  misc_feature (345)..(345): n is a, c, g, or t
  modified_base (414)..(414): a, c, t, g, unknown or other
  misc_feature (414)..(414): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtcggcttgcactcatttatggaatgatgataaccactacagccatctctgacggaccaggctccacctcacgaagacaccgaccaaaaccnggtcgtacctaacactacgaaccaacactacggaccccagtcggaacacacgccaacataactactgtnccaacgacgggagtggcgtgggtgtacgggactacggtcggggaccgagggtcgtccgtcggtacctaccgtcctcctacgacgccctcccgaaccgtaacgggccctacgttcccggttcccttcccccgtggccccgtcccgtagcccgttcccgaacgggtccgaccctacccgttacccggagaccgccgaccggtacccggg

SEQ ID NO: 71784 - DNA, 666 bp, Homo sapiens
  misc_feature: GYAE6OF01BVJJV.21.26.C04.1.454.CMB.1.raw
  modified_base (365)..(365): a, c, t, g, unknown or other
  misc_feature (365)..(365): n is a, c, g, or t
  modified_base (627)..(627): a, c, t, g, unknown or other
  misc_feature (627)..(627): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcgacgacccccggaaaggccccggagtggcttgcactcatttatggaatgatgaataaccactacacgcccatctctagacggaccaggcctaccaccctcgaacgaacggaccaacccgaaccaaaaaccgnggtacgtacctaacacgtacgaaccaacgacgtaccggaaccccaagtcggaaccacgaacgaccaacactaactactgtacgacgaacgacgggagtggacgtggggtcgtagggactacgggtcgggaccgtagggtacgtccgtggtaccgtccgtctccgtacgaccgtcccgtaccgaccgaaccgggcctacggtacccggttccccttccccggtacggtccccgtcccgttacgcccgttccgacgggtacccncccgaacccggtccgaacgaccgcccgacggaccccggg

SEQ ID NO: 71785 - DNA, 771 bp, Homo sapiens
  misc_feature: GYAE6OF01CTZ5B.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggcccggagtggcttgcactctatttagtgaatgatagaactaaccaactacacgcccattcctctcgaacggacccaggcctaccaccctcgaaccggaacggaacccaaccgaacccaaaaaccgtgggtacgtacctaacgactacgaaccaacacgtacgaacccctagtacggaacacgacgaccaacactaacctacgtacgtacgaccaacgacggggtagtacggtcggttaggggtacggtacggggtaccgtacgggtcggggacccgtaacggggtaccgttacccggttacgggttacccgtaaccccggttcccgttccccgtaccgtaacccgtaccccgttaaccccgaaacccggaacccgggtaccccgtaccggtttaccccggttcccccgtttaccccccggtcggtacccccggtccccgtacggtaccccgttacccgggaaccggacccgacccccgtaacccgtacccggaacggtaaccgacccggaaccggtaccccgggg

SEQ ID NO: 71786 - DNA, 684 bp, Homo sapiens
  misc_feature: GYAE6OF01CN4M1.21.26.C04.1.454.CMB.1.raw
  modified_base (470)..(470): a, c, t, g, unknown or other
  misc_feature (470)..(470): n is a, c, g, or t
  modified_base (646)..(646): a, c, t, g, unknown or other
  misc_feature (646)..(646): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcgacgacccccggaaaggccccggagtggtcttgccactctatttagttggaatgatgaataaccactacacgcccatctcgtaggacggaccgaggcctccaccctaccgaacggaacggaaccaaccccgaaccaaaaaaccgacgggttacggtacctaaaccactacgaaccaaacacgtcggaccccagtacggacacgacgaccacactactacgtgtcgacacggacgggngtggcgtggggtcgtaggggacctacgggtcggggccgtaaggggacgttcccgtcggtaccgtacccggttcctacccgtccgaccgtccccgtacccgaaccggacggcccctacgtcccggttaccctcccccgtgggcccccgtcccgtgacccgttcccggacgggacccncccgtacccgtacccggaagacgccgaacggacccggg

SEQ ID NO: 71787 - DNA, 619 bp, Homo sapiens
  misc_feature: GYAE6OF01EVT7M.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggcctcaccctcacggaagacaccgaccaaaaaccnggtacgtacctaacactacgaaccaacactacggaccccagtacggacaccagacccacaactactactgtcgacaacgacgggagtcggcgtggggtgtacgggactacggtggggaccgagggacgtccgtcgtcgacccgttctcctcgacgccctccaaccgaacgggcccctagtccggttccccttcccccgcgggtcccgtccccgtcggtccctccggacggccgtaccctaccgtcccggaagcccgccgtacgacccggg

SEQ ID NO: 71788 - DNA, 569 bp, Homo sapiens
  misc_feature: GYAE6OF01BRAHJ.21.26.C04.1.454.CMB.1.raw
  modified_base (348)..(348): a, c, t, g, unknown or other
  misc_feature (348)..(348): n is a, c, g, or t
  modified_base (453)..(453): a, c, t, g, unknown or other
  misc_feature (453)..(453): n is a, c, g, or t
  modified_base (522)..(522): a, c, t, g, unknown or other
  misc_feature (522)..(522): n is a, c, g, or t
  modified_base (562)..(562): a, c, t, g, unknown or other
  misc_feature (562)..(562): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggaccaccgaccaaaacnggtagtacctaacactgaccaacatcggaccccatggacacacgccacatacactgcgcacgagggagtggcgtggggtgtgggactacggtggggaccgagggngtcccgtgggtccaccggtctccgcacgccctaccgaccgaacggccccagttccggtcccttccccgnggcccgccctgcctccgacggcgccacccgtcgagcgccncgaccgg

SEQ ID NO: 71789 - DNA, 642 bp, Homo sapiens
  misc_feature: GYAE6OF01A2WCU.21.26.C04.1.454.CMB.1.raw
  modified_base (354)..(354): a, c, t, g, unknown or other
  misc_feature (354)..(354): n is a, c, g, or t
  modified_base (481)..(481): a, c, t, g, unknown or other
  misc_feature (481)..(481): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgcccccggaaggccccggagtggcttgcactcatttattggaatgatgataaccactacagcccatctctggaggaccaggcctcgaccctcgacgaacggaccaccgaccaaaaaccgnggtacgtcctaacgactcgaacccaacacgtacggaccccagtacggaaccacacgacccaactactaacctactgtcgacacgtacgggagtggcgtgggtgtcgggacttacgtggggccagggngtccgtggtcctaccgtctccgtcaccgtccctaccgaccggaacggtcccctagtacccgggttcccttaccccccgtagggaccccgtccccgtggtccctcccggacgggacctaccctaaccccgtcccggtaacgaccgccgaacccgtacccggg

SEQ ID NO: 71790 - DNA, 575 bp, Homo sapiens
  misc_feature: GYAE6OF01B1Q0G.21.26.C04.1.454.CMB.1.raw
  modified_base (530)..(530): a, c, t, g, unknown or other
  misc_feature (530)..(530): n is a, c, g, or t
  modified_base (553)..(553): a, c, t, g, unknown or other
  misc_feature (553)..(553): n is a, c, g, or t
  modified_base (566)..(566): a, c, t, g, unknown or other
  misc_feature (566)..(566): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttcgcactcatttattggaatgatgataaccactacagccatctctgaggaccaggcctcaccctcacgaacggaccaccgaccaaaaaccgaggtcggtacctaacactacgaaccaacactcggaccccagtacggacacacgccacactactactgtcgcacgacgggagtggcgtgggtgtcgggactacgtcgggggaccagggacgtccgtggtccgaccgtctccgtcacgccctccacgaacgggccacgtccgtcctccccgngcccgcccgtgcctccgacggcnccacctcgagacncaccggcgg

SEQ ID NO: 71791 - DNA, 741 bp, Homo sapiens
  misc_feature: GYAE6OF01DIM2J.21.26.C04.1.454.CMB.1.raw
tcagtcgtcgctcgcacgaccggtgctcgatttagtctagcgactttggggtttggggggaagaggaagactgacggtcctgctgctgaccatcccttcatgggtcttgtcccagatcaccttgaaggagtctggtcccagctggtacgaaacccacagacgaccctcacgctgacctgctaccttctcttggttttcactcagtaccactgcagtgggtgtgggctggactccgtcaccggacccccgggaaacggccccggagtcggcttgccactctatttagtggaatgatagactaaccactacacgcccatctcgtacggacgaccgaggcctaccaccctacgaacggaaaccggaccaacccgtaaccaaaaaccgtacggtacggtaccaacacctagaaaccaacacgtaccggaacccagtacggaaccacgacgaccataactactacgtgtacgacgaacggagggacggtcggtcgtagggtggtacggacgtagggtcgggaccgtagggtacgttccgtacggttcccgaaccggttcctaccgtccgtaacccggtccctaacccgaaccggtaaaccgggtccccgtaaccggttacccggttccccgtttcccccggtaccgggtcccccgtcccggtacccggtccccgtaccggaaccggtaccgtaccccgtaacccggtacccggaacggaacccgtaccggaacccggtacccgggg

SEQ ID NO: 71792 - DNA, 600 bp, Homo sapiens
  misc_feature: GYAE6OF01CHIMY.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatcctctgacggaccaggctccaccctcgacgaacggacaccgaccaaaaccnggtacgtacctaacactacgaaccaacactcggaccccatcggacacagccacatactactgtcgacacgacgggagtggcgtgggtgtgggactacgtggggccagggacgtccgtggtccaccgtctcctcgacgtcctccgaccgaacgggcccacgtccggtcccttccccggtcggtcccgccccgttgcccgttcccgacggtaccgccctacccgtaccggagaccgccgaccgtaccggg

SEQ ID NO: 71793 - DNA, 639 bp, Homo sapiens
  misc_feature: GYAE6OF01BNWBK.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgaataaccactacagcccatctctgacggaccaggcctcaccctacacgaacgaccaccgaccaaaaaccgnggtacgtacctaacactagaaccaaacacgtacgaccccatacggacacacgccacactactactgtacgacacgacggtagtcggcgtaggggtcgtagggtactacggtcggggacagggacgtccgtggtcctacggtcctccgtacgaccgtccctacccgaaccgtaaccggcccctacgtccggtaccttcccccggtggcccgtaccccgttggaccccgtccgaaccgggacgtacccccgaccggttacccggaacgtccggcccgaccggacccggg

SEQ ID NO: 71794 - DNA, 621 bp, Homo sapiens
  misc_feature: GYAE6OF01BI1VX.21.26.C04.1.454.CMB.1.raw
  modified_base (355)..(355): a, c, t, g, unknown or other
  misc_feature (355)..(355): n is a, c, g, or t
  modified_base (609)..(609): a, c, t, g, unknown or other
  misc_feature (609)..(609): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacacgcccatctctgaggaccaggctcaccctcgaacgaacggaccaccgaaccaaaaaccgnggtcgtacctaacactcgaacacatcggaaccccatcggacacagacccacactactactgtgcacgacgggagtggtcgtggggtgtcgggacgtacggtcggggaccgagggtacgtccgtcggtaccgtaccgtcctcccgtcacgtccctacccaccgaacggccctacgtccggttcccgttccccgtcggcccgccccgtcgacccgttcccgacgggtacgacccgacccgtaccggaacggtaccnccgacgaccggg

SEQ ID NO: 71795 - DNA, 596 bp, Homo sapiens
  misc_feature: GYAE6OF01A5525.21.26.C04.1.454.CMB.1.raw
  modified_base (425)..(425): a, c, t, g, unknown or other
  misc_feature (425)..(425): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttattggaatgatgataaccactacagcccatctctgaggaccaggctcacctcacgaagacaccgaccaaaaaccagtaggtcctaacactgaccaacatcggaccccatcggacacagccacatactactgtgacacgacgggagtggccgtgggngtagggactacgtcggggcagggacgtccgtggtcaccgttctcccgtacacgtccctaccgaaccgaacgggccctaagtcccggttccttacccccgttggacccgtcccgtacgccgtcccgacgggacgacccgtaaccctccggacgacggtccaaccgacccggg

SEQ ID NO: 71796 - DNA, 631 bp, Homo sapiens
  misc_feature: GYAE6OF01CMRNI.21.26.C04.1.454.CMB.1.raw
  modified_base (354)..(354): a, c, t, g, unknown or other
  misc_feature (354)..(354): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttggttttcactcagtaccactgcagtgggtgtgggctggatccgtcacgcccccggaaggcccggagtgcttgcactcatttatggaatgatgaataaccactacagcccatctctgacggaccaggcctcaccctcaacgaacggaccaaccgaacccaaaaaccgnggtacggtacctaacactacgaaccaacagtccgaacccatcggacacacgaccacaactactactgtacgactaccggagggagtgggcgtagggtggtcgggaccgtacgggcggggccgaagggtccgtcgtcggtacccgtaccgttcctccgtcgaccgtccctacccgaccggaaccggtcccacgttcccggttccctacccccggtgccccgtcccgtcgacccgttaccgacggacgacccaccgtccggagccacgacgtacccggg

SEQ ID NO: 71797 - DNA, 599 bp, Homo sapiens
  misc_feature: GYAE6OF01EUCIS.21.26.C04.1.454.CMB.1.raw
  modified_base (348)..(348): a, c, t, g, unknown or other
  misc_feature (348)..(348): n is a, c, g, or t
  modified_base (426)..(426): a, c, t, g, unknown or other
  misc_feature (426)..(426): n is a, c, g, or t
  modified_base (563)..(563): a, c, t, g, unknown or other
  misc_feature (563)..(563): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagccccatctctgaggaccaggctcaccctcacgaaggacaccgaccaaaaaccnggtcggtcctaacactgaaccaaacacgtacggaccccagtcggacacagaccacactactactgtgccacgacgggngtggcgtgggtgtagggactacgtgggcgagggagtccgtggtcaccgtctccgtcgacgccctaccgaccgaacggccctacgtccggtcccttccccgtggtacccgtccccgtcgcccgttccgacgggtaccncccgtacccgtaccggaacgacgacgaccgaccggg

SEQ ID NO: 71798 - DNA, 563 bp, Homo sapiens
  misc_feature: GYAE6OF01CYKAB.21.26.C04.1.454.CMB.1.raw
  modified_base (343)..(343): a, c, t, g, unknown or other
  misc_feature (343)..(343): n is a, c, g, or t
  modified_base (402)..(402): a, c, t, g, unknown or other
  misc_feature (402)..(402): n is a, c, g, or t
  modified_base (443)..(443): a, c, t, g, unknown or other
  misc_feature (443)..(443): n is a, c, g, or t
  modified_base (512)..(512): a, c, t, g, unknown or other
  misc_feature (512)..(512): n is a, c, g, or t
  modified_base (538)..(538): a, c, t, g, unknown or other
  misc_feature (538)..(538): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgcccccggaaaggccccggagtggcttgcactcatttatggaatgatgataaccactacagcccatctctgagaccaggctcaccctcacgagacaccgaccaaaacnggtgcctaacactgaccaacatcggaccccatcggaacacacgccaacatactactgtncacacgggatggcgtgggtggtgggactacggtggggaccnggggagtcccgtggtaccaccgtctccgtcacgccctccaccgaacgggcccagtccgtccttccccgnggcccgtcccgtgcctccacgggacnccgtacccacgagacgcacgaccgg

SEQ ID NO: 71799 - DNA, 673 bp, Homo sapiens
  misc_feature: GYAE6OF01EB0G3.21.26.C04.1.454.CMB.1.raw
  modified_base (170)..(170): a, c, t, g, unknown or other
  misc_feature (170)..(170): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagacgaccctcacnctgacctgcaccttctcttgggttttcactcagtaccactgcagtgggtgtgggctgatccgtcacgacccccggaaggcccggagtggctgcactctatttatggaatgatagactaaccactacagcccatctcgtgacggaccaggcctcacccgtacaacggaacggacaaccgaccaaaaaccgtaaacgtcgtctaaacaactagacgaaccatggacccaatacggacacaagacctaactagtactactacgtacggacgacgacgggtaggtgggtcggtcgggtacgtcggggacgtacggtacggggtaccgtacgggacgtacccgtcgtcctacccgtccgtcccgtaaccacgaccgtacccgaaccgtaacggggtacccctaccgttacccgggtcccgttaccccccgtcggtcccggtccccttcgggaccgtacccgaacgggtacccgaccggaacccgtacccgaacggaacgccggacccg

SEQ ID NO: 71800 - DNA, 778 bp, Homo sapiens
  misc_feature: GYAE6OF01DPAMO.21.26.C04.1.454.CMB.1.raw
  modified_base (688)..(688): a, c, t, g, unknown or other
  misc_feature (688)..(688): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccacagacgaccctcacgctgacctgctaccttctctgggtttcactcacgtaccactgctaggtgggtgtgggctggactccgtcaccggacccccggaaaggccccggagtcggctgcactctatttatggaatgatagaactaaccactacacgacctatctcgtaggacggacctacgcctaccgaccctacgaaccgaacggaacccgaacccgaaacccgtaaaaaaccgtggggttaccggttaaccctaaaccgtaccgtaaccggaaaccctaaaccgtacgttacccgggaaccccaaggttaccggaaaccaccgtaaccggacctaacaaacttaccgtactcggtcgaacctaacggacggggtagtcggtcggtcggggtcgtacgggaccttcgggtcgggacgtacggggacgtttcccggtaggtacccgtaccggttccctacccgtacggacccgtacccgtaacccgaaccggtacccggtccctaaccggtttccccggttccggtaccccccgngggtaaccccccgtccttaccgggacccgtaccggcggaacccggtacccttacccggcgggaaacgccggttcccgaacggtccccggg

SEQ ID NO: 71801 - DNA, 575 bp, Homo sapiens
  misc_feature: GYAE6OF01CSVLF.21.26.C04.1.454.CMB.1.raw
  modified_base (348)..(348): a, c, t, g, unknown or other
  misc_feature (348)..(348): n is a, c, g, or t
  modified_base (550)..(550): a, c, t, g, unknown or other
  misc_feature (550)..(550): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggattgcactcatttattggaatgatgataaccactacagcccatctctgacggaccaggctcaccctcacgaaggacaccgaccaaaaaccnggtcgtacctaacactgaaccaacatcggaccccatcggacacagcccacatactactgtcgcacgacgggagtggctgggtgtgggactacgtggggccgagggacgtcgtggtccaccgtctcctcacggcctacccgaccgaacgggccccaagtccggtcccttcccccgtgggcccgtcccgtgcctcccgaggacnccacccgtccgagacgccacgacgg

SEQ ID NO: 71802 - DNA, 681 bp, Homo sapiens
  misc_feature: GYAE6OF01BKXVX.21.26.C04.1.454.CMB.1.raw
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctgaggaccaggcctccacctcacgaacggaccaaccgaaccaaaaaccaggtacggtacctaaacactacgaaccaaacacgtacgaccccatacggacacacgaccaacatactactgtcgacacgacggagtggcgttgggngtcgggactacggngggcccgtagggacgtcccgtggtaccctccggttcctcccgtacgaccgtccccgtacccgaacccgtaaccggggccccaacgtttccccgggttacccctttcccccccgggtcgggtacccccgtccccgttacgggtccccgttaccccggaacgggacccgtaccccgtaaccccggtacccggaaccggaacgcccgaccgtaacccccgggg

SEQ ID NO: 71803 - DNA, 694 bp, Homo sapiens
  misc_feature: GYAE6OF01AUWJU.21.26.C04.1.454.CMB.1.raw
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtggtgtgggctggatccgtcagcccccggaaaggccccggagtggcttgcactcatttatggaatgatgataaccactacagcccatctctgaggaccaggctcaccctnacgaaggacaccgaccaaaaaccnggtacgtcctaacactagaaccaacactcggaccccagtacggacacacggcctacactacctactgtacgccacgaacgggtagtcggctggggtcgtagggactacggtgggggacccaggggtacgtacccgtgggtaccgtaaccccggttccttacccgtccgtaacgtcccccgttaccccgaacccggtaaaccggggcccccttaacgttccccgggttacccctttacccccccggtggggtccccccgtcccccgtttcggaccccgttccccggaacggggtacgtccccgtaaccccggttcccggaacggtaccggcccgtaacccgggaccgggg

SEQ ID NO: 71804 - DNA, 688 bp, Homo sapiens
  misc_feature: GYAE6OF01CUE79.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggtttcactcagtaccactgcaggtgggtgtgggctggactccgtcaccggaccccccggaaaggccccgggagtcggcttgcactctatttagttggaatgatgaactaaccactacacgacccatcctcgtaggacggaccgacggtcctaccacccgtaccgaacggaacggaaccaaccccgaaaccgaaaaaccgtacgggtacggtacctaaaccgacgtacgaaccaaacactacggaaccccagacggaacacgacgaccacaactactactgtacgacaacgacggaggtcggcgttgggtacggtcggtacgtacggtcggggaccgagggtcgtaccgtggtaccgtccggtcctaccgtacacggtaccctaccgaacccgaccgggtacccgtacgttcccggtcccgtttccccgcggtcccgtcccgtcgtccggtacccgacgggaccgaccgtacccgtacgacggacgccgacgacccggg

SEQ ID NO: 71805 - DNA, 668 bp, Homo sapiens
  misc_feature: GYAE6OF01B17GI.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccggaaagcccggagtggctgcactcatttatggaatgatgataaccactacagcccatctctgaggaccaggctcaccctcaacgaagacaccgaccaaaaacaggtcggtactaacactagaaccaacactacggaccccagtacggaacacacgaccaacactactaactgtcgacacgacgggagtcggcgtggggtagtgggaacctacggtcggggaccgtaggggacgtccgttcggtaccacccggttctaccctcgtaaccgtcccctaacccggaacccgaacgggtacccccgtaagttcccgggttcccccttccccccgggtacggcccccggtaccccgtcggtacccttccccgaacgggaccgtaccccgtacccggtaccccggaaaggtaccggcccgaacccggtacccggg

SEQ ID NO: 71806 - DNA, 625 bp, Homo sapiens
  misc_feature: GYAE6OF01EM4EN.21.26.C04.1.454.CMB.1.raw
  modified_base (361)..(361): a, c, t, g, unknown or other
  misc_feature (361)..(361): n is a, c, g, or t
  modified_base (423)..(423): a, c, t, g, unknown or other
  misc_feature (423)..(423): n is a, c, g, or t
  modified_base (562)..(562): a, c, t, g, unknown or other
  misc_feature (562)..(562): n is a, c, g, or t
  modified_base (592)..(592): a, c, t, g, unknown or other
  misc_feature (592)..(592): n is a, c, g, or t
  modified_base (616)..(616): a, c, t, g, unknown or other
  misc_feature (616)..(616): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgacccccggaaaggccccggagtggcttgcactcatttatggaatgatgataaccactacagccccatctctgacggaccaggcctacaccctacaccggaaggaccaacccgaccaaaaaaccgnggtacggtccctaaacacctagaacccaaacactcggaccccctatcggacacgacgcccanatactactgtcgacacgacgggagtggcgtggggtgtcgggactaccggtcggggccagggcgtccgtgggtccacccgttctcccgtcgacgtccctccgaacgaaccgggcccctagtcccggttcccttcccccgnggtcccgccccgtgccgtccgacgggaccnccgtacccgtcccggaagccgccncgtaccggg

SEQ ID NO: 71807 - DNA, 615 bp, Homo sapiens
  misc_feature: GYAE6OF01BLBA7.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacacgcccatctctgaggaccaggctcaccctcacgaagacaccgaccaaaaccnggtacgtacctaacactacgaaccaaacactacggaccccatacggacacacgaccaacatacctacgtgtgacacgacgggagtggcgtgggtgtgggactacggtcggggccgagggacgtccgttggtccaccggtcctaccgtccgacggtcccctaccgacccgaacgggccctacgtccggtacccttcccccggtcggtccgcccctcggcctcccgacggacgacccgaccgttaccggacggtacgccacgacccggg

SEQ ID NO: 71808 - DNA, 715 bp, Homo sapiens
  misc_feature: GYAE6OF01AEZR7.21.26.C04.1.454.CMB.1.raw
  modified_base (379)..(379): a, c, t, g, unknown or other
  misc_feature (379)..(379): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtggggtgtgggctggactccgtccacggccccccgggaaaggccccggagtcggcttgcactctattttatggaatgatgaactaaccactacagcccatctctaggacggaccacggcctccaccctacgaaccggaacggacccgaacccgaacccaaaaaccgngggtacgtacctaacactacgaaccaacacgtacgacccagtacggacacgacgaccaacacttacctacgtcgtacgaccgaccggacgggggtacgtcgggtacggttagggggtacggtaggggtaaccgttacgggtcgggggaccgtaggggtaccgttccggttacgggtcccgtaccgttcccgttccctacgacccgtccccgtacccgacccgaaccgggtacccgtaccggttcccggtcccttaccccggtccggcccgtcccgtcgtcccgtcccgacggtacgacccgtacccgtaccggaacgaccgccgaccggtaccggg

SEQ ID NO: 71809 - DNA, 743 bp, Homo sapiens
  misc_feature: GYAE6OF01BOUXF.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcaccttctctggtttcactcagtaccactgcgagtgggtgtgggctggactccgtcgaccggacccccggaaaggccccggagtcggcttgctactctatttagtggaatgtatgaactaaccactacacgccctatctcgtaggacggaccacggcctaccacccgtacgaaccggaacggaccaacccgaaccaaaaccgcggtaccgtacctaaccacgtacgaaccaacgacgtaccgaaccccagtaccggaacaacgaccgaccaacaacgtacctacgtcgtacgaccgtaacggacgggtaggtcggacggttggggtacggtacggggtaccgtacgggtacgggggtaccggacggggtaccgtcccggtcggtacccgtacccgttctacccgtcggacccgtccccgtaacccgaaccggacccgggtacccttaccggtcccggtttacccctcccccggtcgggtcccccgtcccggtccgacccggttcccgaacgggtcccgacccgtaccccgtacccggaaggtcccgaccggcccggtaccccgggg

SEQ ID NO: 71810 - DNA, 813 bp, Homo sapiens
  misc_feature: GYAE6OF01DB1NP.21.26.C04.1.454.CMB.1.raw
  modified_base (132)..(132): a, c, t, g, unknown or other
  misc_feature (132)..(132): n is a, c, g, or t
tcagtcgtcgctcgcacgaccggtgctcgatttagtctagcgactttgggtttgggggaagtaggaagactgtacggttacctgctgctgaccatcccttcatgggtcttgtcccgagatcaccttgaaggnggtctggtcccacgctggtgaacccacagacgaccctcacgctgacctgcaccttctctgggttttcactcgagtaccactgcaggtggggtgtggcgtggatccgtcacgacccccggaaaggccccggagtggcttggaccactctaagtttacgttaggaaactcgagttacggaacttaacccacttacgacgaccctactcgttcgacggaacggaccctaacggacctacccaacccgtaccgaacggaacggtaaccaacccggaaaccaaaaaaccgtagggtaccgtaacctaaccgactaccggaaacccaacgaacgtaccgggacccctagtacggaacctaacaccgaacgactaaacgtacttaacgtacgtacgacgaaccgggaccggaagggttcggacggttacgggtacggtacgggtaaccgttacgggccgggtaccggtacgggtaccgttccggtacggttacccgacccgttcctaacccgtccgtaaaccggtccccgtaacccggtacccggtaaaccgggtccccgtaaccgttccccggtcccgtttcccccggtaccggtccccggtcccgtacggtacccttccccgggaaccggccgtacccgtaaccccggtacccggaacccgaccggtacccgccggtaaccccggg

SEQ ID NO: 71811 - DNA, 588 bp, Homo sapiens
  misc_feature: GYAE6OF01EW1LK.21.26.C04.1.454.CMB.1.raw
  modified_base (352)..(352): a, c, t, g, unknown or other
  misc_feature (352)..(352): n is a, c, g, or t
  modified_base (582)..(582): a, c, t, g, unknown or other
  misc_feature (582)..(582): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgacggaccaggctcaccctcacgaaggaccaccgaccaaaaaccgnggtacggtacctaacactacgaaccaacacgtacggaccccagtcggaacacacgccacactactactgtcgacacgacgggagtcggcgtggggtgtcgggactacggtggggccgagggacgtccgtggtccaccgtctcctcgacgtccctaccgaccgacgggccctagtccggtcccttccccgtggcccgcccgtgcctcgaacggcaccgaccgtcgagcgcncgccgg

SEQ ID NO: 71812 - DNA, 794 bp, Homo sapiens
  misc_feature: GYAE6OF01BBV7W.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctgacctgcaccttctcttggttttcactcagtaccactgcaggtgggtgtgggctggactccgtcgaccggacccccggaaggcccggagtcggcttcgcactctatttagtaggaattgatagtactaaccactacacgccatctctggacgaccgcggcctaccacctacgaacgaacgaccacccgaaaccgaaaccgtggtacgtacctaacgtacgtacgaaccaactacgtaccggacccaagtacggaacacgaacgaccaactaactaacctagtcgtacgaccgaacgggtaacgggtacgggttcggtaccgggttggggtttaacgggtaccggggtaaccgttacgggggttacgggggacccgtaacgggggtaccgtttacccgggttacccggtaccggttacccgggttccctaccccgtaccggtaacccggttcccccgtaacccggtaaacccggtaacccgggtaccccttaccgttcccgggttaccccgttcccccggtccgggtaccccgttccccgtaccggccccggttaccggaacgggtcccccgaaccgttcccccggaggtaacccgcccggtaacccgaacgggtcccccgggg

SEQ ID NO: 71813 - DNA, 816 bp, Homo sapiens
  misc_feature: GYAE6OF01C2DNX.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgctaccttctcgttgggtttcactcagtaccacgtgcgagtgggtggtggcgtggactccgtccgaccggacccccggaaacggccccggagtcggtcttcgaccgtactcgtattttagttaggaattgatagaactaacccaactaacgacgaccctatcgtacgtacggacggacccgacggcctaccaccctacgaacggaaccggacccaacccgaacccgaaaaaccggtacggtaccgtaacccgaaaccgtaccgtaacgaacccgaaacgacgttaccggaacccctaacgtacggaaccaaccgaccgaccaacctaactaaccgttaacgttcgaccgacgtaaccggaacgggtacggtcggtacggttcggggtacgggttacgggaaccgttacggggtccggggaccgggtaacgggtccggtttaccggtcggtacccgtacccggttcccgttacccgtacccgtaccggtacccctacccgaaccggtaacccggacccgttacccgttcccggtcccccgtttccccggtaccggacccgttcccgaccggtccgttaccccgggaacgcccggaaccccgtaccggtacccgaaccgtaccgaacccgcccggtacccgggg

SEQ ID NO: 71814 - DNA, 642 bp, Homo sapiens
  misc_feature: GYAE6OF01EBV3P.21.26.C04.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacggcccccggaaaggccccggagtggcttgcactcatttatggaatgatgataaccatacagcccatctctggacggaccgaggcctcacccctcaacggaaacggaccaaccgacccaaaaaaccgnggtacggtaccctaaacactcgaaccaaacagtacggacccccaagtcggaacacacgaccacaactactactgtcgaccacgacgggagtcggcgtgggtggtagggtacgtacggtcggggaccgacgggacgtccgtcggtccgaccgtcctccgtcgaccgtccctccgaacccgaacgggccctacgtccggtcccttcccccggtcggtcccgtcccgtggccctccggaacggcgacccgacccgtccggaagacgccgaccgtacccgggg

SEQ ID NO: 71815 - DNA, 589 bp, Homo sapiens
  misc_feature: GYAE6OF01CQQ64.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaagacaccgaccaaaaaccnggtacggtcctaaacacctagaacccaaacactcggacccccagtggacacagccacatactactgtcgcacgacgggagtggcgtgggtgtgggactacgtggggcccgagggacgtccgtggtccaccgttcctcctcacgtcctaccacccgaacgggcccagtccggtccttccccccgtggcccgtcccctgccctccgacggacgccacccgtccggagacgccgaccgaccggg

SEQ ID NO: 71816 - DNA, 637 bp, Homo sapiens
  misc_feature: GYAE6OF01BIEMW.21.26.C04.1.454.CMB.1.raw
  modified_base (315)..(315): a, c, t, g, unknown or other
  misc_feature (315)..(315): n is a, c, g, or t
  modified_base (393)..(393): a, c, t, g, unknown or other
  misc_feature (393)..(393): n is a, c, g, or t
  modified_base (616)..(616): a, c, t, g, unknown or other
  misc_feature (616)..(616): n is a, c, g, or t
tcagtcgtcgctcgcacgaccggtgctcgatttagtctagcgactttgggtttgggggggaagaggaaggactgacggtcctgctgctgaccatcccttcatgggtcttgtcccagatcacccttgaaggagtctggtcccacgctggtgaaacccacagacgaccctcacgctgacctgcaccttctcttggttttcactcagtaccactgcagtgggtgtgggctggatccgtcgacggcccccggaaaggccccggagtcggcttgcactctattttatggaatgatgaactaaccactacgagctcatctntagagaccaggcctcaccctcgacgaacgaccaaccgtaccaaaacgcggtacggtacctaacacgtacgaccaaacngtacggaccccgagtcgaacacacgaccacaacttactacgtacgtacgaccacggacgggagtcggtcggtagggtacggtagggtaaccgtacggtcggggaccgagggtcgtaccgtcggtcctaccgtcctcctcgaccgtccctaccgaacccggtacgggccctaacggtcccggtccctaccccggtggcccgtcctcggcctccgaggccgtccncccgaccgcgcgccgtaccgg

SEQ ID NO: 71817 - DNA, 670 bp, Homo sapiens
  misc_feature: GYAE6OF01C8ESL.21.26.C04.1.454.CMB.1.raw
  modified_base (464)..(464): a, c, t, g, unknown or other
  misc_feature (464)..(464): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttattggaatgatgaactaaccactacacgccatctctaggacgaccgacggctccaccctcgaacggaacgaaccgacccgaaccaaaacgacggtacgtacctaaacactacgaaccaacacgtaccgaacccagtacggaccacgaacgaccactactaactacgtgtacgacgaacgacgggagtcggnggtgggtaggtgggacgtacggtcggggaccgagggtacgtccggtaggtaccgaccgttctaccctacgaccgtcccgtacccgaccggtaaccggaccctacggtcccggtttccccttccccggtacgggtccccgtccgtacgccgtcccgacggacccggcctacccggttacgaacggtaccgccgaaccgtacccgggg

SEQ ID NO: 71818 - DNA, 590 bp, Homo sapiens
  misc_feature: GYAE6OF01DIWUH.21.26.C04.1.454.CMB.1.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
  modified_base (357)..(357): a, c, t, g, unknown or other
  misc_feature (357)..(357): n is a, c, g, or t
  modified_base (361)..(361): a, c, t, g, unknown or other
  misc_feature (361)..(361): n is a, c, g, or t
  modified_base (580)..(580): a, c, t, g, unknown or other
  misc_feature (580)..(580): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttggttttcactcagtaccactgcaggtgggtgtgggctggactccgtcgacgacccccggaaaggccccggagtcggcttgacactctatttatggaatgatagaataaccactacagcccatctctgagaccagcncaccnacgaagacaccgacaaaacngtcgactanactnacaacagtcgacccatacgacacgacgacaactatactactcgtacgcaacgacgggagtggtcgtacgggtaggtcggactacggtcgggaccgagggacgttccgtcggtcaccggtctcccgtcacgaccctccgaaccgaacgggccctagtcccggttccctccccgtggcccgtcctcgactaccgacgtcgacctccgaacccggagacccncgagacccgg

SEQ ID NO: 71819 - DNA, 684 bp, Homo sapiens
  misc_feature: GYAE6OF01AO6DB.21.26.C04.1.454.CMB.1.raw
  modified_base (287)..(287): a, c, t, g, unknown or other
  misc_feature (287)..(287): n is a, c, g, or t
  modified_base (352)..(352): a, c, t, g, unknown or other
  misc_feature (352)..(352): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtggtgtggctggactcgtcacgcccccggaaggcccgagtgcttgcactcatttatggaatgatgataaccactacngcccatctcgtgacgaccaggctacaccctacaacggaacggaccaacccgtaaccaaaaaccgnggtacggtaccctaacctacgtacgaacccgaaacacgtaccgggaaccccagtacggaaccaacgacgaccgaactaactaactactgtacgacctaacgacgggagtcggtcgtagggtagtacggtaactacggtcggggaccgacgggtacgtccgtacggtacctaccgtccttaccgtcacgtcccttaccgacgaaccggtccctaacgttcccggtcccgttaccccggtcggtaccccgtccccgttaggtcccctaccgggtaccggtccgaaccccgtacccgttaacccgaggaaccggtacccgacggtaaccccgggg

SEQ ID NO: 71820 - DNA, 738 bp, Homo sapiens
  misc_feature: GYAE6OF01EMVKM.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggactccgtcacgcccccggaaaggccccggagtcggcttgcactctatttattggaatgatgaactaaccactaccacgaccccattctccgtggaacggaccacgggtcctcctaccctacgaaccggaaacggaccaacccgaacccaaaaaccgtacggtacgtacccaacacgtacgaaccaacacgtaccggaccccaagtacggaacaccgacgaccaacctaactaacctacgtcggtacgaccgaacgaacggggtaggtcggtcggtaggggtacggtacggggtaaccgtacgggtacgggggacccgtaaggggtacgttacccggtcggtccgtaacccggttccctaccgtaccgacccgtaccccgtacccgaacccggaaccggggtacccctacggttcccgggttcccctacccccgtggtccccgtcccgttcgtcccgtcccggaacggtacccgtacccgacccgtaccggacggaccgaccgccgtacccggg

SEQ ID NO: 71821 - DNA, 674 bp, Homo sapiens
  misc_feature: GYAE6OF01C4I2O.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtgtgggctggatccgtcacgacccccggaaacggccccggagtggcttgcactcatttattggaatgatgataaccactacagccatctctgacgaccaggcctcaccctcaacgaacggaccaccgaaccaaaaaccgaggtacggtacctaaacactacgaaccaaacactcggaaccccagtacggaacacgacgaccaactactactactgtcgacaacgacgggagtggtcgtggggtaggtcgggtaactacgggtcggggaccgaggggtacgttcccggtgtaccgtaccgtccgtccctacgtaccggcccctaccgaaacccgaacgggtcccctaacggttcccggttaccccttcccccggtagggcccgtccccgttggcccgttaccgacgggtaccgcccgtaaccccgtaccggacggaccgcccgaaccggtacccgggg

SEQ ID NO: 71822 - DNA, 725 bp, Homo sapiens
  misc_feature: GYAE6OF01DVWU1.21.26.C04.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtcgaaacccacagagaccctcacgctgacctgcaccttctctggtttttcactcagtaccactgcagtgggtgtgggctggatccgtcacgcccccggaaaggccccggagtcggcttgcactctatttatggaatgatgactaaccactacacgcccatctctgaggaccaggcctcaccctnacgaacggaccaaccgaccaaaaaccgaggtcggtacctaaccactacaaccaacacgtccggaaccccagtacggaacacgaacgaccacactaactactcgtacgactaacgacggggtacttcgggcggttaggggtcggtacgggtacgttaccgggtacgggggacccgtaaggggtacgttcccggtacgggttacccgtacccggttcctcccgttaccgaccgtcccgttaccccgaacccggaaccgggtcccctaaccggttcccggttaccccgttccccccggtacgggtccccgtccccgtaccggtaccctcccggaacgggaccgtacccgtaaccccggttacccggaaggaacccggtcccgaacggacccccggggg

SEQ ID NO: 71823 - DNA, 727 bp, Homo sapiens
  misc_feature: GYAE6OF01DMMRC.21.26.C04.1.454.CMB.1.raw
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacgcccccggaaaggccccggagtggcttgcactcatttatggaatgatgaataaccactacacgccatctntgacgacngctcacctcacgagacaccaccaaaacnggtgtcctaacnctacgaccaacatcggacccagtcggacacacgaccacacttaactactcgtacgaccaacggacgggtaacggtcgggtcggttcggggttaagggtcgggtaacgttacgggttacgggggacccgtaaggggtaaccggttcccggttacgggttacccgtaacccggttcccttaccccgtaccgtaccggtcccccgttacccgaacccgtaaccggggtcccctaacggttccccgggttaccccgtttccccccccggttggggtacccccgtccccgttcggtccccgttaccccgggaacgggtacccgaccccgtaaccccggttaccggaaccggtaccggcccgaaccggtaaccccggggg

SEQ ID NO: 71824 - DNA, 623 bp, Homo sapiens
  misc_feature: GYAE6OF01E2RBG.21.26.C04.1.454.CMB.1.raw
  modified_base (355)..(355): a, c, t, g, unknown or other
  misc_feature (355)..(355): n is a, c, g, or t
  modified_base (430)..(430): a, c, t, g, unknown or other
  misc_feature (430)..(430): n is a, c, g, or t
  modified_base (593)..(593): a, c, t, g, unknown or other
  misc_feature (593)..(593): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactctatttattggaatgatgataaccactacagcccatctctgacggaccaggcctcaccctcgacgaacgaccacccgaccaaaaaccnggtacggtacctaacactacgaaccaacacgtacggaaccccagtacggacacacgaccacaacttactactgtnaccacgacgggagtgcggtgggtggtgggacgtacggtcggggaccgaggggtacgtccgtcggtccaccgtcctcctccgaccgtccctaccgaccgaacgggcccctacgttcccggtcccgttcccccgcggcccgtcccctcggcctcccgacgggacncccgaccctccgaacgcgacgacgaccggg

SEQ ID NO: 71825 - DNA, 683 bp, Homo sapiens
  misc_feature: GYAE6OF01D8N9O.21.26.C04.1.454.CMB.1.raw
  modified_base (129)..(129): a, c, t, g, unknown or other
  misc_feature (129)..(129): n is a, c, g, or t
  modified_base (365)..(365): a, c, t, g, unknown or other
  misc_feature (365)..(365): n is a, c, g, or t
  modified_base (400)..(400): a, c, t, g, unknown or other
  misc_feature (400)..(400): n is a, c, g, or t
tcagtcgtcgctcgcacgaccggtgctcgatttagtctagcgactttgggtttggggggaagagggaagactgacggtcctgctgctgaccatcccttcatgggtcttgtcccagatcaccttgaaggngtctggtcccacgctggtgaaacccacagagaccctcacgctgacctgcaccttctctggttttcactcagtaccactgcaggtgggtgtgggctggatccgtcacgaccccccggaaaggccccggagtggcttgcactcatttatggaatgatgataaccactacaacgccaatctcgtagacggaccaggctccaccctcgaacgaacggaccaaccggaaccaaaaaaccgnggtacggtaccctaaacgtacgtacgaaccaaacngtaccggaacccctaagtcggaacaccacggaccaacacttaaccgtactgtacgaccgaacgacgggtaagtcggacgttggggtaggtacgggtacgtaacggtcggggaccgtaggggtacgtcccgtcggtacctaacccggttctcccgtacgaccggtccctaaccgaacccgtaagggccccctaagtcccggtacccttccccgagggtcccgtccccgttagcctaccggtacggacgacccgacccgtaacgacgaccgcgtaccgacccggg

SEQ ID NO: 71826 - DNA, 177 bp, Homo sapiens
  misc_feature: GYAE6OF01DR8MY.21.26.C04.1.454.CMB.1.raw
  modified_base (175)..(177): a, c, t, g, unknown or other
  misc_feature (175)..(177): n is a, c, g, or t
tcagtcgtcgctcgcacgaccggtgctcgatttagtctagcgactttgggtttgggggaagaggaagactgacggccctgctccaggagcacctccgagagcacagcggccctgggctgcctggtcaaggactacttccctcgtctctactgagcgggctggcaaggcgcatagnnn

SEQ ID NO: 71827 - DNA, 729 bp, Homo sapiens
  misc_feature: GYAE6OF01EMV7F.21.26.C04.1.454.CMB.1.raw
  modified_base (392)..(392): a, c, t, g, unknown or other
  misc_feature (392)..(392): n is a, c, g, or t
tcagtcgtcgctcgcacgaccggtgctcgattttagtctagcgactttgggtttggggggaagaggaacgactgacggtcctgctgctgaccagtcccttcattggtcttgtcccagatcaccttgaaggacgtctggtcccacgcctcggtcgaaacccactagagaccctcacgctgacctgcaccttctcgtgggttttcaactcagtacccacgtgccagtgggtgtagggctggactccgtcacggacccccggaaggccccgtagtcggcttgcactcatttattggaactgtatgactaaccgactacgacgcccgatcttctcggacgggaaccaggtctaccaacccgtgaacggtaaggaccaaccggaccctaaaaaccgnggtacggttaccaacacgtcgaacctaacgactcggaaccccacgtccggaaccaaccgaacgacccgtaacacttaccgtaactcgtcgaccaaccggaaccgggtacggttcggaccgttaggggtcggtaccgggtaacctacggtccggggaccgagggtacgttccgtacgggaccgtaaccgtccgtacccgtacgaccggtccctacccgaacccggaacggtacccctaacggttccggttaccctttccccgaggtccccgtcccgtcggtacccgtaccgacggaccgtacccgtacccgttacggaacgtcgccgcgtaacccggg

SEQ ID NO: 71828 - DNA, 688 bp, Homo sapiens
  misc_feature: GYAE6OF01CVYNI.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacggcccccggaaaggccccggagtggcttgcactctatttattggaatgatagaataaccactacacgccatctctaggacgaccacggcctccaccctacgaacggaacggaccaacccgaaaccgaaaaaccgtagggtacgtaacctaaacactacgaaaccaacacgtacggaccccagtcggaacacacgacacatactactgacgaccgacgacgggtagtcggcgtggggtacggtaggacgtacgggtcgggaccgagggtacgtcccgtggtaccgacccgttctccgtcgaaccgtccctacccgaaccggtaaccgggcccctaacgtcccgggttcccttacccccggtcggacccccggtcccgttccgaccgttacccggaacgggtaccctaccccggtaaccccgtccggaaggacccaccgtaaccggaccccgggg

SEQ ID NO: 71829 - DNA, 755 bp, Homo sapiens
  misc_feature: GYAE6OF01BC6OP.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcaggtgggtgtgggctggatccgtcacggcccccggaaaggccccggagtcggcttgcactctatttatggaatgatgaataaccactacagcccatctctaggacggaccaggcctccaccctcaacgaacgaccaaccgaaccaaaacgcggtcgtacctaacactacgaaccaacacgtaccgaaccccaagtacggaacaccgacgacccaactaactacctaactcgtacgacgaaccggacgggtaggtcggtacggttggggtacggtacggggtaaccgtacgggtacgggggtaccgaaggggtaccgttcccggtagggtacccgtacccggttcctcccgtaccgaccggtacccctaaccccgaacccggtaacccggggacccctaacggttccccgggttaccccgtttaccccccggtcggggtacccccgtcccccggttcggtaccccggttaccccggaccgggtaacccggtaccccgtaacccggttacccggaaacggacccggtacccgacccggtaaccccgggg

SEQ ID NO: 71830 - DNA, 725 bp, Homo sapiens
  misc_feature: GYAE6OF01CUQW7.21.26.C04.1.454.CMB.1.raw
  modified_base (479)..(479): a, c, t, g, unknown or other
  misc_feature (479)..(479): n is a, c, g, or t
  modified_base (709)..(709): a, c, t, g, unknown or other
  misc_feature (709)..(709): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacggctggtacgaaacccacagacgaccctcacgctgacctgcaccttctcgttgggttttcactcagtaccactgcaggtgggtgtgggctggacttccgcaccggacccccggaaaggccccggagtcggcttgcactctatttagttaggaatgatagaactaaccactacacgccctatctacacggacgaccgacggcctaccacccgtacgaacggaacggaacccaacccgaaacctaaaaaccggacgggtacgtaacctaaaccacgtacgaaaccaaacgacgtaccggaacccctagacggaaccacgacgtacccaataactacgtacncggtacgaaccacgggacgggtaagtcgggtcgtaggggtaggtacgggaacgttcgggacggggaccgaggggtactcgtacggccctccggtccttccgacgtcccgacccgtacccgaaacggtacccgggaccctccggtttacccggtcccccgtccccggttacggccccgtacccgttcggaccctcccgggacgcccgtacccacccggtacgaggaacccncggtccgaacccgggg

SEQ ID NO: 71831 - DNA, 668 bp, Homo sapiens
  misc_feature: GYAE6OF01DOWJQ.21.26.C04.1.454.CMB.1.raw
  modified_base (354)..(354): a, c, t, g, unknown or other
  misc_feature (354)..(354): n is a, c, g, or t
  modified_base (430)..(430): a, c, t, g, unknown or other
  misc_feature (430)..(430): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgaactaaccactacacgccatctctgacggaccaggctccaccctcacggaacgacacccgaaccaaaaaccnggtacgtaccaacactacgaaccaaacagtacggaaccccagtcggaacacacgaccaacataacctacgtgtacnccgaacgacgggagtcgggcgtggggtgtacgggacgtacggtcggggacgagggacgttccgtacgggtcccaccggtcctccctaccgacgtcccctacccaacccggaaccggggtcccctaacggttcccggttaccccgtttccccccggtcgggtcccccgtccccgttcgccccgttacccggacggaccgcccgtacccgtacccggagacccggcgacccgtacccggg

SEQ ID NO: 71832 - DNA, 697 bp, Homo sapiens
  misc_feature: GYAE6OF01CEJZB.21.26.C04.1.454.CMB.1.raw
  modified_base (664)..(664): a, c, t, g, unknown or other
  misc_feature (664)..(664): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcacgcccccggaaaggccccggagtggcttgcactctatttattggaatgatgactaaccactacacgccatctctgacgaccgagcctccaccctacgaacgaaggaccaacccgaaccaaaaaccgcggtacgtacctaaaccactacgaaccaacacgtccggaacccagtacgaccacacgaccaacaactactacgtgtacgaccgaacgacgggtagtcgggtcggttaggggtcggttacggggtaaccgttacgggtaccgggggaccggtaacggggtaccggttacccggttcgggtacccgtacccgttcccgtcccgtaccgtaccgaccccttaaccccgaacccggaaccgggtccctaacggttcccgttcccgttccccgtcggtacccgccccgtgacccgtcccgacgggaccnccccacgtcccgaacgacgccgacggtacccgg

SEQ ID NO: 71833 - DNA, 772 bp, Homo sapiens
  misc_feature: GYAE6OF01BZROM.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtagaaacccacagacgaccctcacgctgacctgcaccttctcttgggttttcactcagtaccactgcaggtgggtggtgggctggactccgtcgaccgaccccccgggaaaggccccggaggtcggtcttgaccactactatttattggaatgatagaactaaccacctacacgcccatctctaggacggaccacggcctacctaaccctacgaacggaacggaaccctaaccccgaaacccgaaaaaacccgtagggttaccggtaaccctaaaccgtacgtaaccgaaacccaaacgtaacgtaccggaaccccctaagtacggaaccaacgaccgaacccgaactaactaacgtaacgtcgtacgaccgtaacgacgggtagtcggcggttagggtaggtacggacgtacggtcgggaccgagggtcgtaccgtcggttaccgtaccgtcctaccgtactaccgtacccgtaccgaacccgaacccgggtccctacgggttcccggtaccccgtttcccccggtacgggtccccgtccccgtaccggtccccggtcccgtaaacgggacccgtacccgtaccccggtaccggtaacggaaccgcccgaacccggtacccgggg

SEQ ID NO: 71834 - DNA, 651 bp, Homo sapiens
  misc_feature: GYAE6OF01B4FKI.21.26.C04.1.454.CMB.1.raw
  modified_base (362)..(362): a, c, t, g, unknown or other
  misc_feature (362)..(362): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccacagagaccctcacgctgacctgcaccttctcgttgggttttcactcagtaccactgcaggtgggtgtgggctggactccgtcgacggacccccggaaaggccccggagtcggcttgcactctatttatggaatgatgataaccactacagcccatctctgacggaccaggcctccaccctacacgaacggaccaccgaccaaaacgnggtcgtaccaacactacgaaccaacgactacggaccccagtacgaccacacgaccaacatactactgtcgacacgacgggagtcggtcgtggggtggtacgggacgtacggtcggggaccgaggggtctcccggtaggtcccgtaccgtccgtaccgtcgaccgtcccgtacccgaaccgaccgggccctaacgttcccggtacccgttcccccgtacggcccgtccctcggcccgtacccgacgggaccaccccgtacccgtcccggaagccgccgacgtacccgggg

SEQ ID NO: 71835 - DNA, 703 bp, Homo sapiens
  misc_feature: GYAE6OF01CH5UB.21.26.C04.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggcccccggaaaggccccggagtcggcttgcactctatttatggaatgatgataaccactacacgccatctctgacggaccaggcctcaccctacaacggaaggaccaccgaaccaaaaaccgnggtacggtacctaacactacgaacctaatacgtcggaaccccagtacggaaccacgaacgacccaactaactacctactgtacgaccaaccgacgggagtaggcgtgggtggtcgggactacggtcggggacgagggtactcgtcggtaccaccggttcctcccgtacgaccgtcccgttacccgaacccggtaaccgggtcccctaacggttccccgggttccccttaccccccgggtcggggcccccgttccccgtcggtccccgttacccggacggggtacccgtccccgtaaacccccggtaccgggaacgtaccgggtccccgaaccgggtaccccgggg

SEQ ID NO: 71836 - DNA, 655 bp, Homo sapiens
  misc_feature: GYAE6OF01AF5D4.21.26.C04.1.454.CMB.1.raw
  modified_base (593)..(593): a, c, t, g, unknown or other
  misc_feature (593)..(593): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgcccccggaaaggccccggagtcggcttgcactctatttatggaatgatgataaccactacagccccatctctgacggaccaggctccaccctacgacgaacgaccaccgaccaaaaaccgcggtacgtacctaacactcgaaccaacagtacgaacccataggacacgacgacccaacacttacctactcgtacgaccgaacgacgggtaaggtcgggtacgtggggtcggtacgggtactacggtcggggaccgtaggggaccgtcccgtggtacctaacccggttcctcccgttacgacgtacccctcccgaaccctaaccggggcccaacggttcccgtacccgttccccccgngggccccgtcccgtgcccctcgaaccggacgccctaacccgtcgagacgcccgaagcccggg

SEQ ID NO: 71837 - DNA, 732 bp, Homo sapiens
  misc_feature: GYAE6OF01CL2E8.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtggtgggctggactccgtcaccggacccccgggaaacggccccggaggtcggcgttcgcacgtctatttattaggtaatgatgaataaccactacagcccatctcgtgacggtaccaggcctaccaccctacgaacgaacggaaccaacccggtaacccaaaaaccgacgggtaccggtacctaaaccactacgaaccaacactacggaacccctagacggaacacacgacctactaactaactacctgttaccgacaaccggagggtacggtgggtcggtgggttcgggtacgggaccgttagggtccgggccggtaaggggtccgttaccgtcggtaccgtacccggttccttacccgtccgtacccgtccttaccccggaacccgaaccggggtcccctaccgggttaccgttcccccgttacccccggtcgacccccggtccctacggcccgtacccggaccggtacgtcccgtaccccgtcggaacgaccgtccgaaccggtaccccgggg

SEQ ID NO: 71838 - DNA, 766 bp, Homo sapiens
  misc_feature: GYAE6OF01DG441.21.26.C04.1.454.CMB.1.raw
  modified_base (716)..(716): a, c, t, g, unknown or other
  misc_feature (716)..(716): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctgggtcccacgctgggtacgaaacccacagacgaccctcacgctcgacctgcctacctttcttcgttgggttttcactcacgtaccactgcgtaggtggggttggtgggtcgtggacgtcccggtccgaaccgggaccccccgggaaacgggccccgggaggtcgggtcttgcctactctattttagtggaattgatagaactaaccactacacgtccatctcgtaggacggaccgacggcctaccacccgtacgaacggaacggaccaacccgaaacccgaaaaccgaggttaccgtaacctaacgactacgaaacccgaacaccgtaccggtaacccaacgtacggaacaccgaaccgaccaactaacttaacctacgtacgtacgaccgaacgggacgggtaggtcgggtcggttcggggtaggtacggtaccggtcgggtacgggaccggacgggtaccgtccggtacgtccgtacccggttcctccgttaccgacccgtaccctacccggaaccgtaacccgggtcctaccgggtccccgttcccgtccccgtaccgggtcccgtcccgtccggtaccnccggacgacccgtacccgacccgtaccgacggaccgccgccggtcccggg

SEQ ID NO: 71839 - DNA, 760 bp, Homo sapiens
  misc_feature: GYAE6OF01AVEGO.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcacgtaccactgcaggtgggtgtgggcgtggatccgtcgaccggaccccccgggaaacggccccggagtcggcttgcactctattttatggaatgatgaataaccactacacgcccatctctggacggacacggcctccaccctacgaccggaacggaccaacccgaaacccaaaaacgtacgggtacgtacctaacaaccgtacgaaaccaacacgtaccgaaccccgtagtacggaacaccacgacccaactaactactacgtcgtcgaccgaacgacggggtagtggtcgggttgggttacgggtacgggtaaccgtcgggacgggggtaccgaacggggtccgttccggttacggttaccgacccgttaccgtacccctcgaacccgtccccgtaaccccgtaacggaacccgggtacccctacggttccccggttacccccgttccccccggtaccgggtccccgtcccccgttacggccccgttacccggaaccgggaccctaccccggtaaccccgtacggaacccggaccgtaacgacccccggtacccgggg

SEQ ID NO: 71840 - DNA, 659 bp, Homo sapiens
  misc_feature: GYAE6OF01D3JNJ.21.26.C04.1.454.CMB.1.raw
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (646)..(646): a, c, t, g, unknown or other
  misc_feature (646)..(646): n is a, c, g, or t
tcagtcgtcgctcgcacgaccggtgctcgatttagtctagcgactttgggtttgggggaagaggaagactgacggtcctgcgtgctgaccatcccttccaactgggtcttgtcccagatcaccttgaaaggagtctggtcccagctggtgaaacccacagagaccctcacgctgacctgcacttctctgggttttcactcagtaccactgcagtgggtgtgggctggatccgtcacgccccccggaaagccccggagtggcttgcactcatttattggaatgatgataaccactacagcccatctctgacggaccaggctcaccctgaacgaaggcaccgaccaaaaacaggtcgtcctaaacnctacgacctaaacgntacggaccccagtcggaacaccacggacctaacaacttacctaaccgttgtacgccgaaacgcgggggtagttacgggtccgttcgggggtggttacggggtacctaacgggtttaccgggggacctagggggtacgttcccggtggttacccgaccggttcctcccgtacgaccgtccctaccgaccgtaacgggccctaccgtcgttcccttccccgtcggccgtcccgtgccgttccgacggcctaccgtcgtacccgaggccncgacccgaccggg

SEQ ID NO: 71841 - DNA, 595 bp, Homo sapiens
  misc_feature: GYAE6OF01BGRKU.21.26.C04.1.454.CMB.1.raw
  modified_base (353)..(353): a, c, t, g, unknown or other
  misc_feature (353)..(353): n is a, c, g, or t
  modified_base (494)..(494): a, c, t, g, unknown or other
  misc_feature (494)..(494): n is a, c, g, or t
  modified_base (539)..(539): a, c, t, g, unknown or other
  misc_feature (539)..(539): n is a, c, g, or t
  modified_base (566)..(566): a, c, t, g, unknown or other
  misc_feature (566)..(566): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccattctctgacggaccaggctccaccctcacggaacgaccaccgaccaaaaaccgnggtgtaccctaacactgaaccaacactcggaccccagtacggacacagaccacactactactgtcgacacgacgggtagtcggcgtggggtgtgggacctacggtcggggaccgagggcgtccgtggtacctccgtctccncgacgccctaccgacgaccggccctacgtcccgtccctaccccgnggcccgtccgtcgccgtccgacggacncctacccgtcgacgcgcgtccggaccggg

SEQ ID NO: 71842 - DNA, 877 bp, Homo sapiens
  misc_feature: GYAE6OF01B14VM.21.26.C04.1.454.CMB.1.raw
tcagtcgtcgctcgcacgaccggtgctcgatttagtctagcgactttgggtttggggggaagaggaagactgacggtcctgctgctaaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactctatttattggaatgatagataaccactacagcccatctcgtgaggaccaggctaccaccctcgaacggtaacggaccaacccgaacccaaaaaccgacgggtacggtaccctaaactaccgtacgaacccaaacgtacgtaccggaacccctagtacgggaccaacgacgacccaacgaacttaaccgttaaccgttcggttacgcccgtaaaccggaccgggggaacggttcgggtaccggttaggggggttacgggttacgggggtaacctttaccggggtacggggggccccggtaaagggggtacccgttacccggttacgggttaccccgtaaccccggttccgttcccccgttaacccgtacggtacccccccgttacccgtaaacccccggtaaaccggggtccccccgtaacggtttccccggggttaccccccgttttaccccccccggttaccggggtcccccggttacccccccgtttcgggtacccccttacccccgggtaacggggtaaccccggacccccgttaaccccccgtaacccggggttaaccgggaacccggtccccggaaacccggtaccccggggtaccccccggggg

SEQ ID NO: 71843 - DNA, 721 bp, Homo sapiens
  misc_feature: GYAE6OF01DTW29.21.26.C04.1.454.CMB.1.raw
  modified_base (367)..(367): a, c, t, g, unknown or other
  misc_feature (367)..(367): n is a, c, g, or t
  modified_base (396)..(396): a, c, t, g, unknown or other
  misc_feature (396)..(396): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtgtgggctggactccgtcaccggacccccggaaaggccccggagtggcttgcactcatttatggaatgatgaactaaccactacacgccatcctctaggacggaccaggcctcaccctcgaacggaagaccaaccgaaccaaaaaccgnggtacgtacctaacactacgaaccaaacncgtacggaacccagtacggaacaccgacgacccaacaacgttaacctacgtcggtacaccgaacggacggggtaggtcgggcggtggggtacggtcgggtaacgtacgggtacgggggccggtacgggtaccggttccgttcgggtacccgttaccggccttcccgtaccgacgtccccgttacccgaacccgaaccggggtacccctacgttcccgggttaccccttcccccggtcgggtccccgtcccgtcgtcccgtaccggtaaccggaccgtcccgtaaccccggtcccggaagtaacccggcgtaaccggtacccgggg

SEQ ID NO: 71844 - DNA, 599 bp, Homo sapiens
  misc_feature: GYAE6OF01E0P8W.21.26.C04.1.454.CMB.1.raw
  modified_base (269)..(269): a, c, t, g, unknown or other
  misc_feature (269)..(269): n is a, c, g, or t
  modified_base (354)..(354): a, c, t, g, unknown or other
  misc_feature (354)..(354): n is a, c, g, or t
  modified_base (471)..(471): a, c, t, g, unknown or other
  misc_feature (471)..(471): n is a, c, g, or t
  modified_base (528)..(528): a, c, t, g, unknown or other
  misc_feature (528)..(528): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactntatttatggaatgatgataaccactacagccccatctctggacggaccaggcctcaccctcaacgaagaccaccgaccaaaacgnggtcgtaccaacactcgaccaacagtcggaccccagtcgacacacgccacatacttactgtcgacacgacgggagtggcgtgggtgtgggactacgtggggcaggacgtctcggtcnccgtctcctcgacgcccgtaccaccgaacggtcccacgttccggttcccgtccccgnggtcccgtcccgtcgcccgttcccgacgggtacgaccctacccggtcccgaggtacgccgacgtacccggg

SEQ ID NO: 71845 - DNA, 678 bp, Homo sapiens
  misc_feature: GYAE6OF01CRJW5.21.26.C04.1.454.CMB.1.raw
  modified_base (363)..(363): a, c, t, g, unknown or other
  misc_feature (363)..(363): n is a, c, g, or t
  modified_base (595)..(595): a, c, t, g, unknown or other
  misc_feature (595)..(595): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtgggctggactccgtcacgcccccggaaaggccccggagtggcttgcactctatttatggaatgatgataaccactacacgcccatctctggacggaccacggctaccacccctacgacgaacggaaccaaccgaaccaaaaaccgnggtacgtacctaacactacgaacctaacacgtcgaaccccagtcggaacacacggaccaacgtactacctactgtacgaccaaccgaacgggagtcggtccgtaggggtggtacgggactaccgggtggggcccgaggggtaccgttccgtcggttccgaccgttcctaccctcgaccgtcccgtaccaaccgtaaccgggccctaacgttcccggtccctttccccccggnggccccgtccccgtgaccccgttcccggaacggtacccgcccgtaacccgtcccggtaagacccggacgtacccggaccgggg

SEQ ID NO: 71846 - DNA, 593 bp, Homo sapiens
  misc_feature: GYAE6OF01CFH5M.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttatggaatgatgataaccactacagcccatctctgaggaccaggctcaccctcacgaagacaccgaccaaaaacnggtcgtacctaacactgaccaacatcgaccccatacggacacacgccacatactactgtcgcacgacgggagtggcgtgggtgtgggactacggtggggccaggggatccgtggtccaccgtctcctcacgtccctccaccgacgggcccaagtcccggtccttcccccgtggcccgtccccgtcgcccgtcccgacgggaccgcccgacccgttacccggaagtaccggccgtaccgacccgggg

SEQ ID NO: 71847 - DNA, 778 bp, Homo sapiens
  misc_feature: GYAE6OF01ATAX6.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggactccgtcgacgacccccggaaaggccccggagtcggcttgcactctatttattggaatgatgactaaccgactacacgcccatctctaggacggtaccaggtcctaccacccttacgaacggaacggaccaacccgtaacccaaaaaacccgcgggttacgtacccttaaacgacttacgaacccaaactacgttaccgaacccccgtaagtacggaccaaccgacgaccgaacctacgttaaccgtaacgttcggtaccgaccgtaaccggaccggggtaggtacggtacggttacggggttcggtacgggtaaccgtaacggggtcggggaccgtacgggtacgttaccggttcggtacccggttacccgtccgttacccgtaccgaaccggtccccgttaacccgaacccggtaaccgggtaccccgtaacggttccccggttcccgttcccccggtacgggtccccgtccccgttccggtacccggtccggtaaccgggtaccgacccgtaccccggaccgtacggaacctccggaaaccgtcccgggg

SEQ ID NO: 71848 - DNA, 710 bp, Homo sapiens
  misc_feature: GYAE6OF01EBV2S.21.26.C04.1.454.CMB.1.raw
  modified_base (361)..(361): a, c, t, g, unknown or other
  misc_feature (361)..(361): n is a, c, g, or t
  modified_base (672)..(672): a, c, t, g, unknown or other
  misc_feature (672)..(672): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgcccccggaaaggccccggagtggcttgcactctatttatggaatgatgactaaccactacacgcccatctcgtgacggaccaggcctcaccctacacggaacggaccaccgaaccaaaaaccgnggtacgtacctaaacacctacgaacccaaactacgtacggaaccccagtacgaccacacgacccaactaactaactacgtggtacgaccgaacggtacgggacggttgggtccggtgggggtacggtacggggtaacgtaccgggtcgggggacccgtagggggaccgttccgttcgggttacccgtaacccggttccctacccgttccgacccgtaccccgttacccgaaacccggaaccgggtcccctaacggttccccggttccccttcccccggcggtcccgtccccgtgcccgtccgacgggaccncccgtacccgtaccggaagccggccaccggtacccggg

SEQ ID NO: 71849 - DNA, 764 bp, Homo sapiens
  misc_feature: GYAE6OF01BQWVJ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccacagagaccctcacgctgacctgcaccttctctgggttttcactcagtaccactgcaggtgggtgtgggctggactccgtcacgcccccggaaaggccccggagtcggcttgctactctatttatggaatgatagaactaaccactacacgcccatctctgacggaccaggcctccacctcacgaacggaccaaccgaccaaaacgtggtacggtacctaacacgtacgaaccaactacacgacccagtcgacacacgaccaactactaacctacgttcggtacgacccggaacgtacggggtaggtacgggtcgtacgggggtcggttaacggggtaccgtacggggtacgggggcccggtaacggggaccggttacccggttcgggtaccccgtaaccgttcccgttacccgtccggaccgtcccccgttacccgaacccgggtaacccgggtcccctaaccggttccccggggttacccctttacccccccgggtaccgggtccccggtccccgttacgggccccgttaccccgggaacggttaccccgcccgttaaccccggttacccggaaggaaccccggtaaccgtcccggggaaaccccggg

SEQ ID NO: 71850 - DNA, 668 bp, Homo sapiens
  misc_feature: GYAE6OF01BA8RG.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggccccggagtggcttgcactcatttagtaggatgatgactaaccactacacgcccatctcgtagacgaccacgctaccacctacgacgaacgaccaccgaaccaaaaccgtggtacgtacctaacactacgaaccaacgacgtaccggaccctagtacggacacgacgtaccactacttactacgtcgtacgaccgtaacggacgggtagtcggtacgtggggtacggtacgggtaccgtacggtcggggaccgtagggtaccgttccgtacggtaccgtaccgttcctaccgtacgacgtccctaccgaaccgtaaccgggtccctacggttcccggtacccttccccgtcggtcccgtcccgtacgtacccgtccgacggtaccgacccgtacccgtaccggacgaccgaccgtacgacgg

SEQ ID NO: 71851 - DNA, 645 bp, Homo sapiens
  misc_feature: GYAE6OF01BHRZT.21.26.C04.1.454.CMB.1.raw
  modified_base (333)..(333): a, c, t, g, unknown or other
  misc_feature (333)..(333): n is a, c, g, or t
  modified_base (580)..(580): a, c, t, g, unknown or other
  misc_feature (580)..(580): n is a, c, g, or t
  modified_base (636)..(636): a, c, t, g, unknown or other
  misc_feature (636)..(636): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctcggtcccacgctggtacgaaacccacagacgaccctcacgctgacctgcaccttctcgtggttttcactcacgtaccactgcaggtgggtgtgggctggactccgtcaccgaccccggaaggcccggagtcgctcgactactctatttagtggaatgatagtaactaaccactacacgcctagtctcgacgaccggtaccncggtcctcctaacccgacgaacggtaaccggaccaacccgaaaccaaaaccgtggttacgtaccctaacgactacgaaaccgaacgtaccgtaaccggacccgtaagtacggaaccacgacgaccaactacttaacgtactcgtacgacacgggtacggaggtcggtggtagggacgtggacgtcggtacgggcgtacggcgtccgtcggtctaccgtctaccgtcgcgcctaccgacgccgtaccncggtccgtcccgtcccgccggccgcctcggctccgacgtcgacccgacgcgagccncgcgaccgg

SEQ ID NO: 71852 - DNA, 635 bp, Homo sapiens
  misc_feature: GYAE6OF01BV272.21.26.C04.1.454.CMB.1.raw
  modified_base (621)..(621): a, c, t, g, unknown or other
  misc_feature (621)..(621): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtggtgggctggatccgtccgaccggaccccccgggaaaacgggcccccggaggtcggtcttgccactctattttattggaatgaatgataaccactaacagcccatctctgacggaccaggcctcaccctacacgaaggaccaccgacccaaaaacgaggtacgtacctaaacgactagaaccaacatacggaaccccatcgacacagccaacatactactgtgaccaacgacgggagtcggcgtggggtggtacgggacttacgtgggggccaggggactccgtaggtcacccggttctaccgtcgacgcctacccgaccgtaacggccctagtccggttcccttaccccgcggcccgccccgtgcccgtccgacggacgacccgtacccgtaccgacggacnccgaaccgaccggg

SEQ ID NO: 71853 - DNA, 763 bp, Homo sapiens
  misc_feature: GYAE6OF01B5S29.21.26.C04.1.454.CMB.1.raw
  modified_base (220)..(220): a, c, t, g, unknown or other
  misc_feature (220)..(220): n is a, c, g, or t
  modified_base (524)..(524): a, c, t, g, unknown or other
  misc_feature (524)..(524): n is a, c, g, or t
  modified_base (539)..(539): a, c, t, g, unknown or other
  misc_feature (539)..(539): n is a, c, g, or t
  modified_base (746)..(746): a, c, t, g, unknown or other
  misc_feature (746)..(746): n is a, c, g, or t
tcagtcgtcgctcgcacgaccggtgctcgatttagtctagcgactttgggtttggggggaagaggaagactgacggtcctgctgctgaccatcccttcatgggtcttgtccccagatcaccttgaaggagtctgggtcccacggctgggtacgaaacccacagacgaccctcacgctgacctgctaccttctcttgggttttcactcacgtaccactgcnggtgggtggtgggctggatccgtcgaccggacccccgggaaacggccccggagtcggtcttcgcactctatttagttggaatgactgaacttaaccactaacacgacccctattcgtaccgtaggaaccggaaccgtacggtaccctaccctaaccccgtaaccgaaaccggaaaccgggaaccccgaaaccccggtaaacccgaaaaaacccggtacgggttaccggtaaccctaaacaaccgtaacgaaacccaaacgtaacgccggaacccaagacgacacacgaccaacactactcgtcncgacaccggacgggngtacgggcgtacgggtggtacggaaccgtacgggtcggggaccaggggtaccgtccggtacggttccctaccggttcctccgtacccgaaccgttccccacccggtaaccgtaacccggggcccttacggttccccgtcccgtttccccggcggtcccggtcctacggtccctaccggaccgccggtccctaccgaccggaacgacnccggaaactcccggggg

SEQ ID NO: 71854 - DNA, 593 bp, Homo sapiens
  misc_feature: GYAE6OF01BJ9IV.21.26.C04.1.454.CMB.1.raw
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttatggaatgatgataaccactacagccccatcctctgaggaccaggcctccgaccctcaacgaacggaccaccgaccaaaaaccgnggtaggtaccctaacacctacgaaccaacactacggaccccatcggacaacacgaccacatactactgacncacgacgggagtggacgtgggtgtacgggacgtacgtcgggcgagggacgtccgtggtcctaccgtctcctcgccgccctccgaaccgacggcccagtccggtcccttccccgcgccgtcccgtcgctccgacgcgaccgacctacccgaagcgccgcgaccggg

SEQ ID NO: 71855 - DNA, 642 bp, Homo sapiens
  misc_feature: GYAE6OF01AP5JQ.21.26.C04.1.454.CMB.1.raw
  modified_base (426)..(426): a, c, t, g, unknown or other
  misc_feature (426)..(426): n is a, c, g, or t
  modified_base (486)..(486): a, c, t, g, unknown or other
  misc_feature (486)..(486): n is a, c, g, or t
  modified_base (512)..(512): a, c, t, g, unknown or other
  misc_feature (512)..(512): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactctatttattaggaattggattagaacttaaccactacacgccctaaaatctctgaacgccgaggtcctccaccctcgaaccgaacggacccacccgaaccgaaaaaccgtggtacgtaccctaacgactcgaaccaacactaccggacccagtcgaacacncgaccacactactactgcgaccacggacgggtagtcggtgtgggtgtcgggacgtacggnggggacgagggacgtcgtcggtaccncgttccgtcctcgcgtacccgtccgaccgaccggtccacgtccgtccccgttccccgtccggcccgtcccgttcgcccttccgacgggtaccgacccgtacccgacggtaccgacgccgtacgacccggg

SEQ ID NO: 71856 - DNA, 591 bp, Homo sapiens
  misc_feature: GYAE6OF01A8KAZ.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtcggcttgcactcatttattggaatgatgataaccactacagcccatctctgaggaccaggctcaccctcacgaaggacaccgaccaaaaccnggtggtacctaacactacgaccaacactcggaccccatcggacacagaccacactactactgtcgacacgacgggagtggcgtgggtcgtgggactacgtcggggccaggggacgtccgtggtaccaccgtctccgtcgacgtccctaccgaccgaacggccctacgtccggtacccttccccgacggcccgccctgcccgtccgacggaccgaccgacccgtaccgagcgcgacgtaccggg

SEQ ID NO: 71857 - DNA, 689 bp, Homo sapiens
  misc_feature: GYAE6OF01D8BI7.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcaccttctctgggttttcactcagtaccactgcaggtgggtgtggctggactccgtcacgcccccggaaaggccccggagtcggctgcactcatttattggaatgatgataaccactacacgccctatcctcgtagacggaccacggtcctaccaccctcaacggaacggaacccaacccgaacccgaaaaaccgaacgggttcggtaccctaaacgtaccgtaacgaaacccaaacgacgttaccgaacccgtaacgtacggaccaccgacgacccactactaactactagcgacaaccggagggtacgtgggcgtgggtagtcgggactacggtcggggccgagggtcgtcgttcggacctaccgtcctccgtacgacgtccctaccgacccggaacggtccctaccggtccggttccctcccccggtacggcccggtcccttagcccgtacccgaacggtcccgggacctaccccggtaccggaaggtaccgccgaaccgtacccgggg

SEQ ID NO: 71858 - DNA, 749 bp, Homo sapiens
  misc_feature: GYAE6OF01EJM98.21.26.C04.1.454.CMB.1.raw
  modified_base (355)..(355): a, c, t, g, unknown or other
  misc_feature (355)..(355): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggcccacgctggtgaaacccacagagaccctcacgctgacctgcaccttctctgggttttcactcagtaccactgcagtgggtgtgggctggatccgtcacggccccccggaaaggccccggagtcggcttgcactctatttatggaatgatgactaaccactacagcccatctctgacggaccaggcctcaccctcacgaacgaccaccgaccaaaaaccgnggtacgtaccaacactacgaaccaacagtcgaaccccagtacggacacacgacccaacactacctacgtgtacgaccaacgacgggtagtcggtacgttgggggtggttacggggaaccgttacggtcgggggacccgtaggggtaccgttcccggtacgggtccctaacccggtttccgttaccccgttaccgaacccggtcccctaccccgtaaacccggaaacccggggtacccctaaccggttccccgggttaccccccgtttccccccgggttaccgggtacccccggtcccccgttcggtacccccgttccccgggaaacgggtacccgtcccccgtaaccccgttacccgggaaaggacccggacccgtaacccggacccccggggg

SEQ ID NO: 71859 - DNA, 703 bp, Homo sapiens
  misc_feature: GYAE6OF01DDW83.21.26.C04.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggactccgtcgaccgacccccggaaaggccccggagtggcttgcactcattttatggaatgatgaataaccactacacgcccatcctntgaacggaccagctccaccctcgaacgaacggacaaccgaaccaaaacgacggtcgtacctaacacctacgaaccaacacgtacggaccctagacgacacacgaccacactactactacgtacgacgtaacgacgggagtcggtcgtaggggtgtacggggaccttacggtacggggaccgtacggggacgttccggtacgggtaccctacccggttactcccgtaccgacgtccccgtaacccgacccggtaaccggggtcccctaacggttccccggttccccgttcccccggtccgggcccgtacccccggttgtaccccgttacccggaaccgggtacccgtacccgacccgttaacccggacggaacccgccgaacgtacccgggg

SEQ ID NO: 71860 - DNA, 682 bp, Homo sapiens
  misc_feature: GYAE6OF01DEXEU.21.26.C04.1.454.CMB.1.raw
  modified_base (169)..(169): a, c, t, g, unknown or other
  misc_feature (169)..(169): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacggctggtagaaacccacagacgaccctnacgctgacctgcaccttctctgggtttcactcagtaccactgcaggtgggtgtgggctggactccgtcaccggaccccggaaggcccggagtggctgcatctatttatgaatgatagataaccactacacgacccatctctaggacggaccaggcctacaccctacgaacgaacggaaccaacccgaaccgaaaaaaccgtggtaccggtacctaaacaacgtacgaaaccaacgtacgtacggaaccccgagtacggacaacgacgaccaactaactactacgtgtacgaccaacggtaacgggaggtcggtacgttagggggtaggtacgggaaccgtacggttcggggaccgtaagggtcgtacccgtggtacccgtaaccgtccttaccgtaccgaccgtaccctacccgaaccgaaccgggcccaacgttcccggttacctccccgtcggtcccgccctgacccgtcgaacggacgacctacccggtacgaggacgcacgggtaccgg

SEQ ID NO: 71861 - DNA, 696 bp, Homo sapiens
  misc_feature: GYAE6OF01AQFWU.21.26.C04.1.454.CMB.1.raw
  modified_base (219)..(219): a, c, t, g, unknown or other
  misc_feature (219)..(219): n is a, c, g, or t
  modified_base (650)..(650): a, c, t, g, unknown or other
  misc_feature (650)..(650): n is a, c, g, or t
tcagtcgtcgctcgcacgaccggtgctcgatttagtctagcgactttgggtttgggggtaaggaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgngggctggatccgtcacgacccccggaaggcccggagtggctgcactctatttattggaatagatgactaacactacacgcccatctctcgaggaccgaggtcctccaccctcgaacgaacggacacccgaccaaaacgcggtacggactaaccgactacgaacctaacacgtacgaccccgagtacggaacgacacggcctactaactaccgttctcgtacgtaccgaacgtaccggggagtcggtacggtcggggtggtacgggtacgttaccggtggggtacgacgggtaacggtccggtacgttccgaccgtccttcccgtacccgagtacccctacccggtaccacccgggtacccacgttaccccgggttccttaccccccggtcggggtccctacccccgggtttcacccgtccgaacccggganaccccgtacgacccccggtaaggacggtccccgacgtaaccccggg

SEQ ID NO: 71862 - DNA, 621 bp, Homo sapiens
  misc_feature: GYAE6OF01B36OW.21.26.C04.1.454.CMB.1.raw
  modified_base (496)..(496): a, c, t, g, unknown or other
  misc_feature (496)..(496): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaacggccccggagtggcttgcactctatttattggaatgatgataaccactacagcccatctctgacgaccaggctcaccctcacgaaggaccaccgaccaaaaccaggtcgtactaacactgaaccaacatcggaccccagtcggaacacacgccactactaactactgtcgaccaacgacggggacgtcgggcgtggggtgtacgggactacggtcggggccaggggactccgtgtccgaccgtcctcnccgacgtccctaccgaccgaaccgggcccctaaggtcccggttacccttccccgtcgggccgtccccgtcgacccgtccgacggccgtaccgtacccgtaccgacggacgccgaccgtacccggg

SEQ ID NO: 71863 - DNA, 710 bp, Homo sapiens
  misc_feature: GYAE6OF01A2OJP.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggactccgtcaccggcccccggaaaggccccggagtcggcttgcactctatttatggaatgatgataaccactacacgccctatctctaggacggaccaggtcctccaccctacgaacgaacggaccaaccgaaccgaaaacgaggtacgtacctaacactacgaacctaacacgtacggaacccctagtacggaacacgacgaccacactacctaactgacgccgaacgacgggtacgtaggtacggtagggtggtacgggtacgtacgggtcggggaccgtagggggtaccgtcccggttaggtacccgtaaccggtccgttacccgtccgaaccgtccccgtacccggaacccgtaaccggggccctaacggttccccggttcccggtttacccccgcgggtccccgtcccgtccggcccgttacccgggacggtaccgtaccccgtacccgacccgggaagccgccgaaaccggtcccgggg

SEQ ID NO: 71864 - DNA, 659 bp, Homo sapiens
  misc_feature: GYAE6OF01BOBJ2.21.26.C04.1.454.CMB.1.raw
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaagccccggagtggcttgcactcatttatggaatgatgataaccactacacgcccatcnctgacgacaggctcaccctcacgacgacacccgaccaaaaaccgnggtcgtaccctaacacgtacgaacccaacacgtccggaaccccagtcggaaccacgacgccaacactactacgtgtacgctacgacgggtagtcggtacgtggggtagtacgggtaccgttacggtcggggaccgagggtacgtccggtcggtacctaccggtcctccgtaccgcgtacccgtacccgaaccggaacgggcccctacgtcccgggttcccttcccccggtggtccccgtccccgtgccccgttcccggacgggcccgtaccccgacccgttacggaccggacgtcccgaacggtaccccggg

SEQ ID NO: 71865 - DNA, 751 bp, Homo sapiens
  misc_feature: GYAE6OF01CFLIG.21.26.C04.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacagcccatctctagacggaccaggcctcaccctcacgaacgacaccgaccaaaaaccnggtcggtacctaacactcgaaccaacactacggaccccaagtggaacacaacgccactactaactactgtacgacgaccgaacgggtacgtgggtacgtgggggttcggtacggggaccttaacggtcggggggaccctaagggggtaccggttacccggtcgggttaccgtaaccccggtttcccgttacccggtaccctaacccgggttccccgttaccccgaaaccccgggtaacggggtcccccaaacccggtttcccggggtttacccctttaccccccccggtcgggggtaccccggtccccccgttagggtccccttcccggaaacggggtaccggtaccccaaccccgggtttccccggaaaccggtacggacccgtaacccgggacccgggg

SEQ ID NO: 71866 - DNA, 684 bp, Homo sapiens
  misc_feature: GYAE6OF01A246R.21.26.C04.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtgggctggactccgtcacgccccccggaaaggccccggagtggcttgcactctatttattggaatgatgataaccactacacgcccatctctgacgaccagcctccacctacgacgaacggaccaccgaaccgaaaaccnggtacgtacctaacgactagaccaacacgtaccgaccccagtacggaaccacgacgaccctaacacgttaaccttacctgtacgaccgaaccggtacggggtagtcgggtacggttggggttacggtacgggtaaccgttacggcgggggaccgagggttacgtccggtcggtccgtaccgtccgtcctaccgacgtacccgtccgaaccggtaccggcccgtacggtcccggttacccgttcccccgtcgggaccccgtcccgtcgacccgtacccgacgggtacccgccgtacccgtaccgaacgtaccgaccgcggtaccccggg

SEQ ID NO: 71867 - DNA, 666 bp, Homo sapiens
  misc_feature: GYAE6OF01EAKSS.21.26.C04.1.454.CMB.1.raw
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (424)..(424): a, c, t, g, unknown or other
  misc_feature (424)..(424): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactctatttattggaatgatgataaccactacagcccatctctgacggaccaggctcaccctcacgaagaccaccgaccaaaaaccgnggtacgtaccctaacactacgaaccaanacgtacggaccccagtacgacacacgaccaacactactactgtnccacgagggcgtggccgtgggtgtagggactacgggtgggaccgaggggtacgtccgtcggtccacccgtcctcctacgcctcccgtaccaacccgaaccgggccctacggttcccggttcccgtttaccccccggtcgggtacccccggtccccgtacgggtcccctcccgggtaacgggacccgtccccgtaaccccggttacccggaaaggacccggtccgaacccggtaccccggggg

SEQ ID NO: 71868 - DNA, 756 bp, Homo sapiens
  misc_feature: GYAE6OF01DJHL1.21.26.C04.1.454.CMB.1.raw
  modified_base (515)..(515): a, c, t, g, unknown or other
  misc_feature (515)..(515): n is a, c, g, or t
  modified_base (741)..(741): a, c, t, g, unknown or other
  misc_feature (741)..(741): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagacgaccctcacgctgacctgctacctttctcgttcgggttttcactctacgtaccactgcgaggtgggtggtgggctggactccgtcgaccggacccccggaaacgggcccggaggtggcttcgcactctatttagttaggaatgatagactaaccatacacgccatctcgtaggacgaccgacggtcctcctaacccgtaccgaaacggaaaaccggaaccgaaaccccggaaaacctaaaaaaacccgtaggggttaacccggtaaccctaaacctaaccgtaaccgaaaccgtaaacacgtaccggaaccccaaggtaccgaacgaaccacgaccaactaactactacgtcgngaaccgacggaaccgggtaggtcggtcggttggggtcggtacgggaaccgttcgggtaggggaccggtaacgggtacgttaccgtcggtaccctacccggttctcccctcggacctaccctacccgaacggacccgggaccctacgttcccggttcccgttaccccggcggtaccccgcccgtcgaccccgtccgacggacccgccgaaccgtacccggaagaccncccgacggacccggg

SEQ ID NO: 71869 - DNA, 833 bp, Homo sapiens
  misc_feature: GYAE6OF01DUBTS.21.26.C04.1.454.CMB.1.raw
tcagtcgtcgctcgcacgaccggtgctcgatttagtctagcgactttgggtttggggggaagagggaagactgacggtcctgctgctgaccatcccttcatgggtcttgtcccagatcaccttgaaggagtctggtcccacgctggtcgaaacccacagagaccctcacgctgacctgcaccttctcgtgggttttcactcagtaccactgcgaggtgggtggtgggctggactccgtcgaccgacccccggaaaggccccggagtggtcttgcactctatttagttaggaatgatgaactaaccactacacgccatctacgtacggacggaccgaggtcctaccacccgtacgaacggaacggaacctaacccgaaccgaaaaaccggcggttacggtaacctaaccaaccgtacgaaacctaaacgacgtaccggaaccccgaagtaccggaactaccgaacgtacccaaacgaaaccttaaccgtacgtacggtaacgaaccgtaaccgggtaacggggtacgggtaccgggtaacgggttcggggttacgggtacccgggtaccgggttaacccggggtaccgggggacccggaaacgggggttaccggttacccggtacggggttaacccgcccggtttcccttaccggaccctaccgggtacccctaacccgaacccggggaacccgggtcccctaacgggttcccccgggtttaccccttcccccgggttaggtcccccggtcccgttacggtacccttacccgggaacggtacccggccccgtaaccggtaacccggaggtaacccgaccgtacgggaccccggg

SEQ ID NO: 71870 - DNA, 803 bp, Homo sapiens
  misc_feature: GYAE6OF01DHF09.21.26.C04.1.454.CMB.1.raw
  modified_base (317)..(317): a, c, t, g, unknown or other
  misc_feature (317)..(317): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtagaaacccacagagaccctcacgctgacctgcaccttctcttgggttttcactcagtaccactgcaggtgggtgtgggctggactccgtcaccggacccccggaaacggccccggagtcggcttgcactctatttagtggaatgatgaactaaccactacacgccatctntaggacggaccgacggctccaccctacgaacggaacggaccaacccgaaaccaaaaccgaggtacgtacctaaacactacgaaccaaacacgtaccggaacccagtacgaaccacgacgaccaactaactaccgtacgtacgtacgtaccgaacggacggggtagtcgggtcggttaggggtacggtacgggtaaccgttacggggtaccgggggaccgtaacggggtaccgtttccgttaccgggttaccccgtaacccggtttcccgtacccgtaccggtacccggtaccccttacccggggaaacccgaccgggggtacccccttaacgggtttccccccggggttttacccccttcccccccgggcgggtaccccccgttcccccggttaggcccccggttaaccggaaaccgggttccccgaaccccgttacccccgggtaacggaacggtaacccgcccggtaaacccggaccccggggg

SEQ ID NO: 71871 - DNA, 650 bp, Homo sapiens
  misc_feature: GYAE6OF01BXT3A.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcaccttctcttgggttttcactcagtaccactgcaggtgggtgtgggctggactccgtcgacggacccccggaaggccccggagtcggcttgacactctatttagtgaatgatgaactaaccactacacgccatctctggacggaccaggcctaccaccctacgacggaacggacccaacccgaaacccgaaaaaccgaggttacggtaaccctaaacgacctacgaaacccaacacgtaccggtaaccccaagtacggaacacgtacgaccaacgtactactactgtcgaccgacggacgggtagtcgcggtggtcggtcggtacgtcggacggggacgtagggcgttcgtcggccgacgtccgtccgcaccgtcccaccgaccgaccggtcctacgttcccgtacccttcccggcggccacccgtgcccgtccgacgccgcctacccgcggaacgtcgccgacgtcccggg

SEQ ID NO: 71872 - DNA, 757 bp, Homo sapiens
  misc_feature: GYAE6OF01CAINH.21.26.C04.1.454.CMB.1.raw
  modified_base (480)..(480): a, c, t, g, unknown or other
  misc_feature (480)..(480): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagacgaccctcacgctgacctgcaccttctcgttgggttttcactcagtaccactgcaggtggtggtggcgtggatccgtccgaccggaccccccgggaaacggccccgggagtcggtcttcgcactctattttagttaggaatgatagactaaccactacacgccatctctacggacgaccgaggcctaccaccctaccgaacggaacggaccaacccgacctaaaaaccgacggtacgtaccctaacacgtacgaacctacacgtaccgaacccagtacgaacacgacgaccaacataccacgtgtacaccgacgaacgggngtggtcgttaggggtgtacgggtacgtacggtcggggacccggtaacggggtacgttcccggtacggttacccgtacccgttcccctaacccggttcctaacccgggtaccccgttaccccgaacccggaacccggggtccccttaaccggttccccggttcccccttccccggtccgggcccccgttaccccgttcggtcccgtaacccggaccggtaaccggtccccgacccggttaccccggaaggccccgtaacccgacccgtaccccggggg

SEQ ID NO: 71873 - DNA, 746 bp, Homo sapiens
  misc_feature: GYAE6OF01CDU2Z.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtgtgggctggatccgtcacggacccccggaaaggccccggagtggcttgcactctattttattggaatgatagactaaccactaacacgccctatctcgtgacggaccacggtcctaccaccctacgaacggaacggaccaacccgaaccaaaaaccgacgggtacgtaccctaaacctacgtaacgtaaccaaaccacgtacggaaccccagtacggaaccacgacgaccaactactactacgtgacgacaccgggacggacggtacggcggttggggtaggtacggtacgtacgggtcggggtaccggtagggtacggttccggttccggtaccgtacccggttcccttcccgtaccgtaccggtccccttaaccccgaaccggtaacccgggccctaaccggttcccggttacccctttcccccggtaccggtcccccgtaccccggtccgtacccgtcccggtaacggacccggtacccgtaccccggtaccggaaccgaccggaccgacccggtaacccgggg

SEQ ID NO: 71874 - DNA, 639 bp, Homo sapiens
  misc_feature: GYAE6OF01BRZW5.21.26.C04.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtcgaaacccacagagaccctcacgctgacctgcaccttctctgggttttcactcagtaccactgcagtgggtgtgggctggatccgtcacggcccccggaaaggccccggagtggcttgcactctatttattggaatgatgaactaaccactacacgccccatctctggacggaccaggcctcacccgtcacgaacggaccaaccgaccaaaaaccgnggtacgtacctaacactacgaaccaactacgacggaaccccagtacggacaaccgacgcccaacactacctactgtacgacgaccgacgggaggttcggacggtggggtggttacgggaccggttacggcgggggccgtagggtacgttccgtggtacctaccgtcctcctcgacgcctccgaaccgaccggccctacgtccggtcccttccccgacggtcccgcccgtgcccgtccgaggacgtcccaccgtccggagccgtcgacgacccggg

SEQ ID NO: 71875 - DNA, 606 bp, Homo sapiens
  misc_feature: GYAE6OF01B560E.21.26.C04.1.454.CMB.1.raw
  modified_base (344)..(344): a, c, t, g, unknown or other
  misc_feature (344)..(344): n is a, c, g, or t
  modified_base (460)..(460): a, c, t, g, unknown or other
  misc_feature (460)..(460): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgcctggtcgaaacccacagagaccctcacgctgacctgcaccttctctggttttcactcagtaccactgcagtgggtgtgggctggatccgtcacgcccccggaaagccccggagtggcttgcactctattatggaatgatgataaccactacagcccatctctgaggaccagcctcacctcacgaacgacaccgaccaaaaacnggtcgtacctaacgactacgacctaaacgactacggtaacccccagtacggaaccacacgaccaacgaactactactgtcgaccacgacggagtgcgtgggtagtcggactacggngggtaccgagggactccggtgtaccaccgtcctcctacgcgtacccgtaccaaccgacggtcccgtatcccggttaccttccccgtacggcccgtccctgcccttccncgggacncccgtaccgtcccgagaccgcctcgaccggg

SEQ ID NO: 71876 - DNA, 614 bp, Homo sapiens
  misc_feature: GYAE6OF01CSSL9.21.26.C04.1.454.CMB.1.raw
  modified_base (263)..(263): a, c, t, g, unknown or other
  misc_feature (263)..(263): n is a, c, g, or t
  modified_base (309)..(309): a, c, t, g, unknown or other
  misc_feature (309)..(309): n is a, c, g, or t
  modified_base (346)..(346): a, c, t, g, unknown or other
  misc_feature (346)..(346): n is a, c, g, or t
  modified_base (590)..(590): a, c, t, g, unknown or other
  misc_feature (590)..(590): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggccccggagtgcttgcnctcatttatggatgatgataaccactacacgccatctctgagaccnggctcaccctcacgaacgaccaccgaccaaaaaccgnggtacgtacctaacactacgaaccaacgacgtacggaaccccagtcggaaccaacgacgacccaactaactaaccttactggtcgaccaacgacggggagtcgggtcgtggggtagtcgggacgtacggtcggggccgaagggtcgtccgtggtcccaccggttctacccgtgacgtcccaccgaaccgacggcccgtacgtcccggttccctccccgtggcccgtccctgcctccgacggacncccaccgtccgagccgcacgccgg

SEQ ID NO: 71877 - DNA, 631 bp, Homo sapiens
  misc_feature: GYAE6OF01CMAX1.21.26.C04.1.454.CMB.1.raw
  modified_base (437)..(437): a, c, t, g, unknown or other
  misc_feature (437)..(437): n is a, c, g, or t
  modified_base (489)..(489): a, c, t, g, unknown or other
  misc_feature (489)..(489): n is a, c, g, or t
  modified_base (586)..(586): a, c, t, g, unknown or other
  misc_feature (586)..(586): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcaccttctcttgggttttcactcacgtaccactgcaggtgggtgtggcgtggatccgtcgaccggacccccggaaaggccccggagtcggtcttgcacttctaattttagttggaatgatagaataaccactacacgcccatctcgtgacgacacggctccaccctagaacgaacggaccaaccgaaccaaaacgcggtacgtaccaacctactacgaaccaacacgtacgacccagtacgacacacgacacatactacngtacgcaacgacgggagtgcgtgggtcggtaggaccgttacggtgggaccgngggtagttccgtaggtaccaccgttctaccgcaccgtccctaacccgaccggaacgcccgtacgtccggtcccgttcccccgtacgtcccgccgtcncccgtccgacggcccaccacccggtacgagccgccgtacgccggg

SEQ ID NO: 71878 - DNA, 729 bp, Homo sapiens
  misc_feature: GYAE6OF01A1U8X.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtagaaacccacagacgaccctcacgctcgacctgcaccttctcttgggttttcactcagtaccactgcgtaggtgggtggtgggctcggtacgttccggtaccgaccggaccccccgggaaacgggcccccgggaggttcggcttacgctacttctattttacgttaggaagtgtaagtagtaactaaaccaactaacgacgtacctacttctacgtacggaacggaccgacggtccgtaccacccgtaccgaacggaaacgaaccgaacccgaaacccaaaaaccggtacggttacggtaaccctaacgaacgtacaaaccaaacgacgtaccgaacccagtacggaacgacacgaccaacgaactactacttcgacacgacgagggtaggcggtcggtaggtcggtacggcttacgggcgggacacgggtacctcggtcgcctaccgtccgtactacccgacgttcccgaccaccgaccggtaccctccgtcccggttccctcccggcgacccgccgttaccgccttacggaccggccctaccgggtacccaggtaaacccggccgtaaccgacgggtcccgg

SEQ ID NO: 71879 - DNA, 678 bp, Homo sapiens
  misc_feature: GYAE6OF01C3AI3.21.26.C04.1.454.CMB.1.raw
  modified_base (127)..(127): a, c, t, g, unknown or other
  misc_feature (127)..(127): n is a, c, g, or t
  modified_base (155)..(155): a, c, t, g, unknown or other
  misc_feature (155)..(155): n is a, c, g, or t
  modified_base (362)..(362): a, c, t, g, unknown or other
  misc_feature (362)..(362): n is a, c, g, or t
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
  modified_base (660)..(660): a, c, t, g, unknown or other
  misc_feature (660)..(660): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggngtctggtcccacgctggtacgaacccanagacgaccctcacgctcgacctgcctaccttctcgttggtttcactcagtaccacgtgcgtaggtcggtgtcggctaggactccgtcaccggacccccggaaggcccgagtcggtcttcgactactctaagttttagttggaaatcgtaagtacgtaaactaaccctagtaccaacgtacctaactcgtacgtcggaaccgtaaccncggtcctaccgacctcgaacgacggtacccaaccgaaaccaaacgtcggttcgacctaacncgtacgaactaaagcgtcgacccagtcgaacncganccaatctactctacgtcacacggtacggaggtgtcgtagggtacgtcggtactcgggtacggaccgtagggtacctaccgtcggtcctaccgtcgcctccggaacgttcccgaccgaaccgggaaccgtccgtaccggttcccgttacccacccggtcgaccccgtcgtacgccggttacgaacggtccaccgttccgacncgtacgccctggacccgg

SEQ ID NO: 71880 - DNA, 627 bp, Homo sapiens
  misc_feature: GYAE6OF01BEM91.21.26.C04.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctccaccctcacgaagaccaccgaccaaaaaccnggtgtaccctaacactacgaaccaaacatacggacccccagtcggaaccacacgcccaacactacctactgtcgaccacgacgggaggtggcgttggggtgtgggacgtacggtggggccgagggtcgtcgtcggtcgccgtcctcctcgacgtccctacccgaccgaaccgggccctacgtcccggtcccgttcccccgtcgggtccccgcccgttccgcccttccggacggtaccgacccgtacccgtccggaacgaccgccgaccgtacccggg

SEQ ID NO: 71881 - DNA, 692 bp, Homo sapiens
  misc_feature: GYAE6OF01CLI6S.21.26.C04.1.454.CMB.1.raw
  modified_base (678)..(678): a, c, t, g, unknown or other
  misc_feature (678)..(678): n is a, c, g, or t
tcagtcgtcgctcgcacgaccggtgctcgatttagtctagcgactttgggtttggggggaaggaggaagactgacggtcctgcctgctgaccatcccttcatgggtcttgtcccagatcaccttgaatgagtctcggtcccacgctggtgaaacccacagacgaccctcacgctgacctgcaccttctcttggttttcactcagtaccactgcagtgggtgtgggctggactccgtccacggacccccggaaaggccccggagtcggcttgctactctatttatggaatgatagaactaaccactacacgccattctgtcgacggaccagcctccacctcaacgaacgaccaaccgaaccaaaaccgcggtacgtaccaacctacgaccgaaccaaacgtacgtaccggaaaccccagtacggaaccaacacgacccacgtaactaccgttaacgtcgtacgaccgaacggtacgggtacgtgggccggttggggtcggtacgggaacggttcggaccggggcgtaacgggtccgtccgtaggtcccgtacccgttcctcccgtaccaccgttcccacccgacccggaaccggtccctaccgttcccggttccccgttccccggtccggtcccgtccctcgcccgtaccggacgccgaccccgttaccgcccggaacnccggaccacccggg

SEQ ID NO: 71882 - DNA, 864 bp, Homo sapiens
  misc_feature: GYAE6OF01ADQLJ.21.26.C04.1.454.CMB.1.raw
tcagtcgtcgctcgcacgaccggtgctcgatttagtctagcgactttgggtttggggggaagaggaagactgacggtcctgcttctgaccatcccttcatgggtcttgtcccagatcaccttgaaggagtctggtcccacgctggtacgaaacccacagacgaccctcacgctacgacctgctacctttctcgttggttttccactctacgtacctactgacgtaggtgggtggtcggcgtaggcgtccgtcgacccggacccccgggaaaggccccggaggtcgtcttcgactaccgttactagttttagtagtagtacgtactaacgtaactaacctaactaccgaccgtaccctacgtaccgtagtaacggaaccggaccgtaaccgtaccctacccgtaacccgtacgaaaccggaaccggaacccgaaaccccgtaaacccgtaaaaaccgggtacggtaaccgtaaacccgaaccgtacgtaacccgaaacctaacgtaccgtaacccggaacccgtaacggtacgaaccaaccgaccgtaaccctaaacgtaacttaccgtactacgtacggtaaccggaaccggtaacgggttacggtacgggtacgggttacgggtacgggtacggttaacggtaccggggtaccgggtaacggtaccggtaccggttaccggtacgtaccgtacccgtccgtacgtacccgaccgtaccccgtaaccggacccgtaccggtacccgttaccggttcccgttacccgtacccggtccgttacccgtaccggtacccgtaccggtacgacccggtacgacccgtaacccggtaccgacggacccgaccgaccggtccgggtacccg

SEQ ID NO: 71883 - DNA, 878 bp, Homo sapiens
  misc_feature: GYAE6OF01ACWCB.21.26.C04.1.454.CMB.1.raw
  modified_base (814)..(814): a, c, t, g, unknown or other
  misc_feature (814)..(814): n is a, c, g, or t
tcagtcgtcgctcgcacgaccggtgctcgatttagtctagcgactttggggtttgggggggaagaggaagactgacggtcctgctgctgaccatcccttcatgggtcttgtcccagatcaccttgaaggagtctggtcccacgctggtgaaacccacagacgaccctcacgctgacctgcaccttctcgttgggttttcactcacgtaccactgcgaggtggggtggtgggcgtggacgtccggtaccgaccggaccccccgggaaacgggccccgggaggtcggtcgttcgcctaccttcgttaagttttattaggaataggtataggtaactaaacccactaaccacgccccactctctacggacggtaccgacggacctcccgaccctacgaaaccggtaaccgggacccaacccggaaccccgaaaaaccgtagggttaccgggtaccctaaacctaaccgtacgaaacccaaactaaccgacccgggtacccctaaggtaacggaccgaaccgtaccgaacccgtaactaaactaacccgttaacgtacggtaccggacaaacccgggaacggggtacgggtacggggtcgggtttaggggtacggggttaaccggggtacggttaaccgggggtacgggggtcccgggaaggggttaccgggtttcccggtacgggtaaccccggttccgtaccccgttaccccgtaccgtacccgtccccgtacccggaacccggttaaccgggccccttaaccggttcccgggtaccccgtttacccccgggccggtaccccggtcccggttcccncccggtccgggaccggacccgaccgtaaccccgtcggaaccgcggaccgaacggtccccggggg

SEQ ID NO: 71884 - DNA, 696 bp, Homo sapiens
  misc_feature: GYAE6OF01BMLI1.21.26.C04.1.454.CMB.1.raw
  modified_base (380)..(380): a, c, t, g, unknown or other
  misc_feature (380)..(380): n is a, c, g, or t
  modified_base (584)..(584): a, c, t, g, unknown or other
  misc_feature (584)..(584): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcagtgggtggtgggctggatccgtcacgaccccccgggaaaggccccggagtcggcttgcactctatttatggaaatgatagaactaaaccactaactacgccctaatcctcgtacggaacggaccacggcctaccaccctacacgaacgaccaacccgaccaaaaacccgnggtacggtacccaaacgactacgaaccaacgtactaccggacccaagtcggacaacgagcccaacaatactactgtacgaccgacgacgggagtcggacgtggggtagtccgggtacttaccgcggggccgtaagggtcgtccgtaggtacccaccgtctcccgacgtaccgacctacccgtaaccgaaccgggccccgtaacncccgggtttcctaccccccggttcgggccccgtcccgtaccggtaccctcccggaacgtccggacccctaacccggtacccggaacggtaccgacccgaaccgaccccgggg

SEQ ID NO: 71885 - DNA, 800 bp, Homo sapiens
  misc_feature: GYAE6OF01BRMC5.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtcgaaacccacagacgaccctcacgctgacctgcaccttctcgttgggttttcactcacgtaccactgcaggtgggtgtggctggatccgtcaccggacccccggaaacggccccggagtcggtcttcgcactctatttagttaggaatgatagaactaaccactacacgccatctcgtacgacggtaccacggtcctaccctaccctacgaaccggaaaccggaacccgaacccgaaaacccaaaaaccgtaggtaccgtaaccctaaacgaccgtaacgaaaccctaactaacgtacccggtaaccccagtacggaacctaacgaccgaccctaacgtaactaaccgttactcgtacgaccgaacggtacgggtacggtcgggacggttggggtcggtacgggtaccgtacgggtacgggggacccggtagggtaccggttcccggttacgggtacccgtcccggttccttacccgtcccgtacccggtacccccgtacccggaaccccgggtaaccgggccccgtccggttacccgggttccccccgttaccccgggccggtccccggtcccgtacggtccccggtaccgaaccgggtccgaccccgtaaccccggttacggaaccggacgacccggaccggtacccgggg

SEQ ID NO: 71886 - DNA, 754 bp, Homo sapiens
  misc_feature: GYAE6OF01AKQMM.21.26.C04.1.454.CMB.1.raw
  modified_base (302)..(302): a, c, t, g, unknown or other
  misc_feature (302)..(302): n is a, c, g, or t
tcagtcgtcgctcgcacgaccggtgctcgatttagtctagcgactttgggtttgggggggtaaggagggaagactgacggtcctgctgctgaccatcccttcatgggtcttgtcccagatcaccttgaaggagtctggtcccacgctgggtcgaaacccacacgacgaaccctcacgctcgacctgcaccttctcgttggttttcactcacgtaccactgacaggtggggtggtgggctggactccggtcaccggacccccgggaaggccccggaggtcgcttcgcactctatttatggatnagtagtaataccacgtacacgcctaacgtctcgacggacgaccgcggtacctaccacccgtacaacggaccggacctaaccgaaccaaaacgtagggtcgtacctacgaacctgaaacctaacacgtaccggaccctagacggaaccacggtacgaccaacgtaactaaccttactcgtacgacgtacggacgggtagtacgggtcggtacggggtaggtaccgggtactaccgggtaacgggccgggtacgggacgtcccggttacggtccctaacggtcccttaccgaccgtaacccgtcccgtaacccgacgtaacccgggaccccgttaccggtacccggttccccttccccggtaccgggtcccgtaccccgcgttcccggtaaaccggcccgggaacctacccggaccccgtacggaaaccggtcccgaaccgtacgggacccggg

SEQ ID NO: 71887 - DNA, 724 bp, Homo sapiens
  misc_feature: GYAE6OF01EPRZ1.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcacctttctcttgggttttcactcagtaccactgcaggtgggtggtgggcgtggatccgtcgaccggaccccccggaaacggccccggagtcggcttgcactctatttattggaatgatagaactaaccactacacgcccatctcgtgacggaccacggcctccaccctacgacggaacgaccacccgaaccaaaaaccgacggtacggtacctaacactacgaaccaaacacgtaccggaacccctagtacggaacaacgacgaccaactaactaactactggtcgaccgacggacgggagtacgggcggttggggtggtacgggtaccgtcgggtacgggggaccgtacggggcgttccgtacgggtccgtacccgtccttacccgtaccgaccgtccctacccgaacccggtaaccgggccctacggttcccggttccccgttacccccgtcgggaccccgtccccgtacggtccctacccggaaccgggaccgtaccccgtaccccgttaccggaaccggacggacccgaccggtacccgggg

SEQ ID NO: 71888 - DNA, 717 bp, Homo sapiens
  misc_feature: GYAE6OF01ALOG6.21.26.C04.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaagccccggagtggcttgcactcatttatggaatgatgataaccactacagccatctctgaggaccaggctcaccctcacgaaggacaccgaccaaaaaccnggtcggtcctaaacactagaaccaacatcggaaccccatcggacacacgccaacatactactgtagaccacgacgggagtcggcgttggggtagtggggaccttaacggtggggacccgaggggtacgtcccgttagggtccgaacccgttcccgtacccgttccgaaccggtacccccgttaccccgaaacccggtaaaccgggggtaccccctaaccggtttccccggggttaccccgttttaccccccccgtcgggggtacccccgtccccccggttacgggccccgtttaccccggaaccgggggaacccggccccgtaaccccggttacccggaaccgggtaacgccccggaaccgtaaccccgggg

SEQ ID NO: 71889 - DNA, 759 bp, Homo sapiens
  misc_feature: GYAE6OF01CB4A7.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgacccccggaaaggccccggagtggcttgcactcatttatggaatgatgaataaccactacagcccatctctaggacgaccaggcctccaccctacgaacgaacggaccaacccgaaccaaaaaccgtgggtacggtacctaacactacgaaccaacacgtacgacccatacggaacacacgacctacactactacgtcgagaccacgacggggagtgggccgttggggtcggtagggtaccgtacggtcgggggaccgtaggggacgttcccgtacgggtacccaacccggtttcctacccgttaccgaccgtacccccgttaccccgaaaccgggaaaccccgggtccctaacccggtttcccgggttacccccctttcccccccgggtcggggccccccgttcccccggtttaccgggaccccccgttaccccggggaaaccgggtaacccgtaccccggtaaacccccggttacccgggaaacgggtaacccgcccggaaacccggtaacccccgggggg

SEQ ID NO: 71890 - DNA, 764 bp, Homo sapiens
  misc_feature: GYAE6OF01BPPNW.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagacgaccctcacgctgacctgcaccttctcttcggtttcactcacgtaccactgcgagtgggtgtggctggactccgtcaccggcccccggaaacggccccggagtgcttgcactctatttatggaatgatcgaactaaccgactacacgccactctcgtacgacggaccacggcctaccgaccctacgaacggaacgaccaacccgaaccgaaaaaccgtcggtacgtacctaaaccacgtaccgaaccaacgacgtcgaaccccagtacggaactaaccgcgacccaacaacttacgtacgtcgtacgaccgaacggagggtacgtacgggcgtggggtacgtacgggtactacgggtccgggacgtaacggggtcgtacccggtcgtacccgtaccggttacctcccgtaacgtacccggtaccccgtaacccgtaaccccgggacgggtaccccgttaccggtttacccgggttcccccgttaccccgggtaccggggtacccccgtcccgttacccggaccccggttacccgggaacggtaaccccgtaaccgtacccccggttaccggaccgaccgggtaacccgacccgggtacccgggg

SEQ ID NO: 71891 - DNA, 693 bp, Homo sapiens
  misc_feature: GYAE6OF01EOF7S.21.26.C04.1.454.CMB.1.raw
  modified_base (651)..(651): a, c, t, g, unknown or other
  misc_feature (651)..(651): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtcggcttgcactctatttattggaatgatgaataaccactacagcccatctctggacggaccaggtcctaccacccctacgaaccggaacgaccaacccgaaccaaaaaccgcgggtacgtacctaaacgacctacgaacccaacactaccggaaccccagtcgaacacgacgacccacactaacctactggtacaccaacgacggggtacgtgggcgttggggtaggtcgggacgttacgggtacggggccgtagggaccgttccgttcggaccgtacccgtccgttacccgtcgaccgtcccgtacccgaacccggaccgggacccctacggttcccggttccccgttccccccgtgggccccgtcccgttacggcccgtccgaccgggaccncccgtaacccgtccggaacgtaccgccgaccggtaacccggg

SEQ ID NO: 71892 - DNA, 833 bp, Homo sapiens
  misc_feature: GYAE6OF01BKYRI.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtggctggactccgtcacgccccccggaaaggccccgagtggtcgtgcactctatttattaggtaagtagtatagtacgtaaactaacctaacgtaacgccgtaacctcttcctacggtaacgggtaacccggaccggaccggtccctaccccgtacccgaaccggaaaaccggaaaccggaaccccgaaaccccgaaaaaaccccgtaaaacgggtaacgggttacccgtaaaccctaaaccgtaccggtaacccgaaaacccgtaaaccgtaaccggtacccccgaacccgttacggaaccgaaacccgaccgaacccgtaacccaacctaaccgtttaaccgttacgtcgtaccgaaccgtaacggggtaacgggtcgggacggtcggggttacgggtaggggtaccggtaccggttacggggaccggtacgggtacgggtccgttcgggtccgtaccggtcccttaccgtccgtaccggtcccttacccgaccgtaaaccgggaccccgtacgtcccggttcccggttcccccgttccggaccccggtccgttcccggaccggtccaaccgggacgtacccgaccctaccggaccggacgccgtacgacccggg

SEQ ID NO: 71893 - DNA, 1119 bp, Homo sapiens
  misc_feature: GYAE6OF01D4Z92.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccacagacgaccctcacgctgacctgcctaccttcttcgttgggttttccactcacgtaccacgtgcgaggtggggtggtgggtcgtggtactcccgtaccgaccggaccccccgggaaacgggccccggaggtcggtccgttcggacctaccgttacttagttttagttaggtaattcggtaagtacgtaacctaaccgtaaccgttaacaccggaccctaacgttcgttacgtacggaaccggacccgtacgggtccctacccgaccccgtaaccggaacccggaaaccggaacccgtaaacccccggaaaacccgtaaaaaacccggtacgggttaacccggttaacccctaaaccgtaaacccggttaacccgggaaaacccctaaacccggtaaccggttaaccccgggtaaacccccgtaaacggttaacccgggaaccctaaacccgaaccccggtaaccccaaacccgttaaaccgtttaaccccgttaaccgttaccgggttaaccggaaccccgtaaaccgggggtaccgggggttaacgttccggggggttaccgggttacgggggttaccgggggttaaccggggtaacccgggtttaacccggggggtaccgggggacccgggttaaacggggtttacccggttcccggttaacccgggttccccgttaacccggttccccgttacccggtaccccggtacccggtacccccgttaaacccggaaacccccggggtaacccggtccccggttaccccgggtttaaccccggtttccccccccggtttacccccgggtaccccgggtaccccccggtttacccccgttccggtaacccccgggttaaccccgggtaaacccggggtaaccccgtcccccccggttaaaccccgggggtttacgaacccccggggtacccgtaacccccgggtaaccggggtaacccccccggggg

SEQ ID NO: 71894 - DNA, 674 bp, Homo sapiens
  misc_feature: GYAE6OF01D9H55.21.26.C04.1.454.CMB.1.raw
  modified_base (366)..(366): a, c, t, g, unknown or other
  misc_feature (366)..(366): n is a, c, g, or t
  modified_base (599)..(599): a, c, t, g, unknown or other
  misc_feature (599)..(599): n is a, c, g, or t
  modified_base (636)..(636): a, c, t, g, unknown or other
  misc_feature (636)..(636): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtgtgggctggactccgtcaccgcccccggaaaggccccggagtcggctgcactctatttatggaatgatgaactaaccactacacgaccctatctctggacggaccaggcctccaccctcgacggaacgaccaacccgaccaaaaccgnggtacgtacctaacactacgaaccaacacgtacgaccccagtacgaacacacgaccacgtaactactactgtcgacgaccggagggtacgtacgggtcgtgggtaggtcgggaccgttacgggcgggaccgaggggtcgtccgtggtacccgtaccgtccgtccctacggaccgtaccccgtaccgaacccggtaaccggcccgtaacgttcccggttaccccttcccccggnggtaccccgtcccgtcgaccggtaccgacgggacccncccgtaacccgtccggagacctccggaccgtacccggg

SEQ ID NO: 71895 - DNA, 809 bp, Homo sapiens
  misc_feature: GYAE6OF01C3OGM.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctgggtacgaaacccacagacgaccctcacgctgacctgcctacctttctcgttgggttttcactcagtaccactgctaggtgggtggtcgggcgtggtactccgtccgacccggacccccggaacgggccccggaggtcggcttgacactctatttataggaatgatagactaaccactacgacgccattcctcgaggtacggacctacggtacctccaaccctaccgaacggtaacgaaccaaccgaaacccgtaaaaccgacgggtacgtaacccgtaactacgaaccgaaccctaaacaccgtaaccgacccgtaagtaccggaacaccgtacgaaccactaacttaaccgtacgtcgtacgaccgtaacggacggggacggtcgggtcggttaggggtcgggtaccgggtaacggtaccgggttcggggaccgggtacggggtaccgttaccggtacgggtaccccgaccgtttcccgtaccgtaccgtccggtaccccgtaccgtaaccccgggaccggtaccccgtacgggttcccccggtttccccgttccccccggtaccgggccccgtccccggttcggaccccggttcccggaaacgggtcccccaccggttaaccccgacccggtaacgacccggccgtaacccgggtacccgggg

SEQ ID NO: 71896 - DNA, 964 bp, Homo sapiens
  misc_feature: GYAE6OF01CRWS0.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagacgaccctcacgctgacctgctaccttctcgtgggtttcactcagtaccactgcaggtgggtgtgggctggactccgtcgaccggacccccggaaaggccccggagtcggcttgccactctattttagtggaatggatacgaacttaacccgacttaaccacgtaccctattcctcgtacgggacggaaccctacgggcctacccgaacccgtaccgaacggaaacggaaccgtaaccccgaaaccctaaaaaaacccggcgggttaaccggttaccctaaaccgtacgtacgaaacccaaaccgtaacgtaccgggtaacccccaaggttaccgggaacctaccgaacggacccaacctaaccgttacgttaccgtacggttaccgaccgaaccgggtaacggggtacgggttagggtccgggttaacgggggtcggtaacccgggggtaaccgttaaccgggggttccgggggtaaccccggtaacggggggttacccgttacccgggttaccgggtaccccgttaaaccccgggtttcccgttacccccgttacccgggaacccggttaccccccgttaaacccggaacccccggggttaaaaccccgggtccccctaaaccgggttttccccggggttaccccccgttttcccccccgggtaacgggggttcccccccggtccccgttacccggggttacccccgtaccccggtaaaacggggtcccggttaacccccgtaaccccgggtacccggaacccgggtacccggtaaccccggttaccccggtaacccccggggg

SEQ ID NO: 71897 - DNA, 957 bp, Homo sapiens
  misc_feature: GYAE6OF01E3IHV.21.26.C04.1.454.CMB.1.raw
tcagtcgtcgctcgcacgaccggtgctcgatttagtctagcgactttgggtttgggggaagaggaaggactgacggtcctgctgctgaccatcccttcatgggtcttgtcccgagatcaccttgaaggagtctcggtccccaggcctggtacgaaacccacgacgacgaccctcgaccgctgacctgcctaccttctcgttgggttttcactcacgtaccactcgcaggtcgggtggtcgggtctggacttccgtacgaccggacccccgggaaacggccccggagtcggcttcgctacgtacgtagtttacgtagggtaatggtaattacgaacgtaacctaacgttaaccgacctaccgtaactccgtacgtacggaaccggaaccgacggtccctaccgacccctaccgaacggaacgtacccgaaccgaaacccgaaaaaccgtcgggttacgtaaccctaaccgtaacctacgtaaacccgacgtaaccgtacccggaaacccgtacggtaaccggaaccaaccgaaccggacctaaccgtaactttaaccgacgttacggaaccgtacccgtaacggacgggtacggttcggacggttggggtacggttcggggtaacgtacccggggtacgggtacccgggtaaggggttacccgtacggttaccgggtacccgtaccggtttaaccctaaccccgttcccggtaaccccgggtaccccgtaaacccggaacccgggttaacccgggtacccgtttaacccggttccccgggtttaccccccttaccccccggggtaaccggttccccccggggtaccccgtttaaccggggccccccggtaaaaccggggggtacccgtaaacccccgggttaccccccggtaaaaccgggggtttaccggaaaccggggtttccccggaaaccccgttcggggggaaaccccccgggg

SEQ ID NO: 71898 - DNA, 589 bp, Homo sapiens
  misc_feature: GYAE6OF01AO7LV.21.26.C04.1.454.CMB.1.raw
  modified_base (305)..(305): a, c, t, g, unknown or other
  misc_feature (305)..(305): n is a, c, g, or t
  modified_base (440)..(440): a, c, t, g, unknown or other
  misc_feature (440)..(440): n is a, c, g, or t
  modified_base (495)..(495): a, c, t, g, unknown or other
  misc_feature (495)..(495): n is a, c, g, or t
  modified_base (563)..(563): a, c, t, g, unknown or other
  misc_feature (563)..(563): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacgcccccggaaaggccccggagtggcttgctactcatttattggatagatagataaccataccagcccanctctgacggaccaggctcaccctacacgaacggacaaccgaccaaaaccgagtcggtacctacactacgacaacatacggacccagtagacacacgaccaacactactactagtacgacacgacgggtaggtcgnggtagggttggacgggtactaggtcgggacgagggacgtcgtcggtccaccgtcncctcgaccgtccaccaccgacggcccacggtccgtcctaccccgtcgccgcccgtcgcgtccacggancctacccgcgacgacgccgagcccgg

SEQ ID NO: 71899 - DNA, 615 bp, Homo sapiens
  misc_feature: GYAE6OF01BDMIL.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgcccccggaaaggccccggagtggcttgcactcatttattggaatgatagataaccactacagcccatctctgacgaccaggcctcaccctcacgaacggaccaccgaccaaaacgnggtcgtacctaacactacgaaccaacagtacgaccccagtacggacacacgccaacactactactgtcgcacgacgggagtcggcgtggggtaggtcggaccgtacggtcgggaccgtagggtacgtccgtggtaccgtaccgtctccgtacgaccgtccctaccgaaccgacgggccctacgtcccggttccttccccgcggtcccgcccgttcggcctcccgacggaccgacctacccgacgacgacgccgccggtaccgg

SEQ ID NO: 71900 - DNA, 706 bp, Homo sapiens
  misc_feature: GYAE6OF01BG6QP.21.26.C04.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtgggctggatccgtcacgcccccggaaaggccccggagtggcttgcactcatttatggaatgatgactaaccactacacgccctatctcgtaggacggaccaggtcctccacccgtacgaaccggaaacggaccaaacccggaacccgtaaaaaaccgngggttaccgtaaccctaaccgacccttacggaacccaaactaccgtaccggaacccccgtagtaccggaacaaaccgacgtaccaactaacttactacgtgtacgaccgaacggtacggggacgttcggccggttggggtacggtacgggtacgtacggtcggggaccgtacgggtacgtccgtcggtaccctccgtctccctcgaccgtccctaccgaaccgtaccggtccctaccgtcccggttacccgttccccgtacggtcccgtcccgtcggaccctccggacggccacccgtacccgtcggaacgtccgaccgtccgtacccggg

SEQ ID NO: 71901 - DNA, 837 bp, Homo sapiens
  misc_feature: GYAE6OF01DBKRF.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagacgaccctcacgctgacctgcaccttctcgttgggttttcactcagtaccactgcaggtgggtgtgggctggactccgtcaccggacccccggaaacggccccggagtggcttgcactctattttagtaggaatgatacgaactaaccactaccacgcccatcctcgtaggacgaccacggtcctaccaccctacgaacggaacggaaccctaaccccggaaaccgaaaaaccgtcgggttaccgtaacctaaaccgtaccgtaacgaaaccctaaacgtacgtacccggaacccctaaggtaccggaacctaccgacgaccctaactaacctaaccgttacgtggtaccgaccgtaaccgggtacggggtacggttcggtcgggttacggggtcggttacggggtaaccgttaaccgggtccgggggtaaccgtacggggttaacccgttccggttaccggtaccccgttaccgtttccccgtacccgtaccggtaacccgtacccccggtaacccgaacccgggtaacccgggtcccgtaaccgtttcccccgggttacccccgttcccccgggtcggtaccccccgtcccggtaccgttacccggttaccggaacgggtcccctaccgtaccccgggttaaccgacggtaacccgacccgaaccggtccccgggg

SEQ ID NO: 71902 - DNA, 811 bp, Homo sapiens
  misc_feature: GYAE6OF01AKA5A.21.26.C04.1.454.CMB.1.raw
  modified_base (236)..(236): a, c, t, g, unknown or other
  misc_feature (236)..(236): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (338)..(338): a, c, t, g, unknown or other
  misc_feature (338)..(338): n is a, c, g, or t
tcagtcgtcgctcgcacgaccggtgctcgatttagtctagcgacttgggtttgggggtaaggaggaagactgacggtcctgctgctgaccatcccttcatgggtcttgtcccagatcaccttgaaggagtctggtcccacgcctggtcgaaacccacagagaccctacacgctgacctgcaccttctctgggtttcactcagtaccactgcaggtgggtgtgggctggatccgtcnccggacccccggaaaggccccgagtcggcttgccagtcctatttagttaggaatgatgaacttaaccgactacncgacccctntacctctaggacggaaccncggacctccaccctacgaccggaaacggacccaacccgtaaacccaaaaccggtaggttacggtacccgtaaacacccgtagaaacccagaaccgtacccggaaccccgtactaaggaacccaccgacgaaaccgacctaaacgtacccttaaagtcggtacgaccgtaacggtaaccgggaggttcggtaccggtggggttacggtacgggttccgaacgggttcggggaaccggtacggaccggtttcgtaccggtacccgtacccgttccgtacccgtccgtacccgtacccccgtaaccgtaacccggtaaacccggggtacccctacccggttaccggttacccccgttcccccgggtccgggtaccccccgtcccggtacccgtacccggtaaccccgaccggggttacccgaaccccggtaccgtaccccgggaacccggtacgaccccgtccgggtaaccccggg

SEQ ID NO: 71903 - DNA, 753 bp, Homo sapiens
  misc_feature: GYAE6OF01CI4BB.21.26.C04.1.454.CMB.1.raw
tcagtcgtcgctcgcacgaccggtgctcgatttagtctagcgactttgggtttgggggggaagaggaagacctgacggtcctgctgctgtaccatccttcatggtcttgtcccagatcaccttgaagagtctggtcccagtcgtggtacgaaacccacagtacgtaccctcgtacgctacgtaaccgtcgcctaccttcgtcgttgggttttcactcgtaggtaccacgtgacgaggtcgggtgtcgggctcggtacgtcccgggtaccaccggacccccggaaacggtcccggtagtcgtctcggcctactctatttacgtagatgatacgaactaaccactacacgcctactcgcgtaggacgaccgtacggacctaccaccgtacgaacggaacgaccgaaccgaacctaaaacgtggtaccgtacctaacgcgtaaccgaacctaacgactcccggaaccctacggtaccggaactaccgaacgtacctaactacgttacctacggttcgaacgacgtaaccgggtacggtacgtcgggtacgttggggtacgttacgggactacggggttcggaccgtaagggtacttccggagtacccgacgtcgtacccgcgacctacccgtaccgaaccgtaccgtccttacggtcccgtcccgtaccgcgggtcccgttccgtaggtacccgtcggacggaccccggttacccaccggttaccggacggaccgtacccgggaccctacccgggg

SEQ ID NO: 71904 - DNA, 738 bp, Homo sapiens
  misc_feature: GYAE6OF01B4P9D.21.26.C04.1.454.CMB.1.raw
  modified_base (721)..(721): a, c, t, g, unknown or other
  misc_feature (721)..(721): n is a, c, g, or t
  modified_base (728)..(728): a, c, t, g, unknown or other
  misc_feature (728)..(728): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagacgaccctcacgctgacctgcaccttctctgggttttcactcagtaccactgcgaggtgggtgtgggctggactccgtcacggacccccggaaacgggccccggagtcggtcttgctactctatttatggatgatgaactaaccactacgacgcccactctctagacggaccgaggcctaccaccctacgaccggaaacggacaacccgaaccgaaaaaccgacggtacggtaccaaccgactacgaaccaactacgtacggaacccctagtacggaacacctacgaccccaactaacttaccgtacgtcggtacgaccgaacgtacggggtaggtacgggtccgttaagggggtcggtaacggggacccttacgggtaggggggacccttaacgggggacgttcccggttcgggttacccgtaacccggttcccgttaacccgtccggtacccggtccccttaccggaacccggtaccgggacccttacggtaccccgttcccgtccccgtcgggtacccgtccctcggtacccgtccgacggtcgacctccgacccggtanaccggtnaccgtccggg

SEQ ID NO: 71905 - DNA, 946 bp, Homo sapiens
  misc_feature: GYAE6OF01AJP6E.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtccccacgctggtgaaacccacagagacccctcacgctgacctgcaccttctctgggttttccacctcacgtaccactgcgtaggtggggtggtcgggtcgtggacgtcccgtcgacccgggaccccccgggaaacgggccccgggtaggtcggtcgttcggacctaccgttccttaagtttttaacgtttagggtaaagttcggtaacgttacgggtaaaaccttaaaacccctaaccgtttaaacccgaaccgggtacccccttacgttaccgttcccgttaacgggaaccgggtaacccgaacgggtcccttaccccgaacccccttacgaaacccggaaacggaaccccgaaccccgaaaccccgaaaaaaacccgtacgggtttaccggtaaccccgtaaaccgaaccgttaccggaaaccccgaaccgtaacggttaaccccggaacccccgtagtaccggaacccaaccgaacccgacccaaacctaacctaaccgttaccgtcggtaaccgaccgaaccgggtaacggggtgggttaccggtcgggttaggggtacggttacgggaccgttaccgggtacggggacccgggtaagggtaccggttcccggttacggtcccgtaaccgttcccgtacccgtaccgtccgtaccccgttacccgaaacccgggtacccggacccttaccggtccccgttccccgttcccccgtcggccccgttccccgtcggtcccgtaaccggtaccggaccccggtcccgtaaccccgttacccggaggaccccgaacgtccgggtaccccggg

SEQ ID NO: 71906 - DNA, 803 bp, Homo sapiens
  misc_feature: GYAE6OF01APZ3B.21.26.C04.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagacgaccctcacgctgacctgccaccttctcgtgggtttcactcagtaccactcgcaggtggtgnggctggatccgtcaccggcccccggaaggccccggagtcggtcttgcctacgtctattttagtaggaatgaagtcgtaactaaccctactaccacgacccgtatccgttcgacggtacggacccgtaggccctaccgacccgtacgaacggtaacggaccaaccccggaaccaaaaccggtggtaccggtaccctaacgacctaacgaaccaacgtacgtaccggaaccccagtacgacaccaccgtccaactacgtaacctcgtacgtacgtaccacggtacggtaggtcggtcgttacggggtacggtacgggtacgtaacggtccggggaccggtacgggtcgttacccggttacggtacccgtaccggtacccttacccgtaccgacccggtacccttaaccccggaaccggttaaccccgggacccgttaccggttcccgttacccccggttccccccgttacgggtcccccggttaccccgtccggttaccccgtccgggtaacccggtacccggtaccccgtacccggtaccccggtaacggtacccggcccggtaacccggtacccccgggg

SEQ ID NO: 71907 - DNA, 719 bp, Homo sapiens
  misc_feature: GYAE6OF01A04WW.21.26.C04.1.454.CMB.1.raw
  modified_base (286)..(286): a, c, t, g, unknown or other
  misc_feature (286)..(286): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtggtgggctggactccgtcacggacccccggaaggccccggagtcggcttgcactctatttatggaatgangataaccactacacgcccagtctcgtgacggaccaggctccaccctcaacggaacggaccacccgaaccaaaaacgcggtacggtacctaaccacgtcgaaccaacgacgtaccggaaccccctaggtacggaaccaacgtaccgacccgaactaacctaaccttaacgtcgtacgaccgtaacgaccggggtacggtcggtcggttggggtaggttacggggaaccgtacgggtcggggaccgaaggggtccgtaaccggttcgggtacccgtacccgtccgttcccgccgtacgtccccgtaccgaacccgtaccgggtaccctacggtcccggttcccgttaccccccggtcggtaccccgtcccgtcggtccgtccccggaacgccgtaccccgtaccgtacccggagaccggtccgccggtacccggg

SEQ ID NO: 71908 - DNA, 862 bp, Homo sapiens
  misc_feature: GYAE6OF01B1OWP.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctcggtcccacgctggtcgaaacccacagacgaccctcacgctcgacctgcctaccttctcgttgggttttcacctcacgtaccactgcgaggtgggtgtcggctggactccgtcgaccggacccccggaaaggcccggagtcggtcttgcctactctagtttacgtagaatacggtatacgtaacctaaccgtaactacgaccgtacctagtcctacgtacgggaacgaccgtcggtacctacccacccgtagaacggaacgaacccgaaacccgaaaccgtaaaaaccgtgggtaacccgttaaccaaacctaccgtaaccgaaaccaacgtacgtacccggaacccaggtaccggaacaaccggactacctaaactacgtaaccgttaacgtcggaccgtaaacccgtagggaaccggggtgttacccggggaggttcggggtaacgtacgggtaacccgtcgggggttaccgggaccgggttacggggtaacccttccggttaacccggtaccccgtacccggttaaccgttccccgtacccgtacccgtaaccccgtaaccggtaaaccccgggtacccggtacccttaccgggttcccccggttaccccgtttcccccgggacggttccccccgtaccggtacccggttacccgaaccgggacccgtaccgaaccccggtaccgggtaacgaaacccgggtccgaaccccggtaacggtccccggg

SEQ ID NO: 71909 - DNA, 651 bp, Homo sapiens
  misc_feature: GYAE6OF01A16E2.21.26.C04.1.454.CMB.1.raw
  modified_base (388)..(388): a, c, t, g, unknown or other
  misc_feature (388)..(388): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgacccccggaacggccccggacggtggctcgcactactatttattggaatgatgaataaccactacagcccatctctgacggaccaggcctcaccctcacgaacggacaccgaaccgaaaaccacggtacggtacctaacactacgaccaacancgacccatcgacacagcacatactactgtacgcaacgacgggagtcggacgtgggtcgtggacgtacggtcgggccgagggaggtccgtcggtaccgtaccgtctcccgtacgaccgtccgtacccaacccgtaacgggacccccgtacgttcccggttccccgtttacccccgtccgggtacccggtccccttacccggccgttccccgacgggtaccgcccggtaacccgcccggaacggtcgacccggacgtacccgggg

SEQ ID NO: 71910 - DNA, 733 bp, Homo sapiens
  misc_feature: GYAE6OF01CAR5Z.21.26.C04.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacggccccccggaaaggccccggagtcggcttgcactctatttatggaatgatgaactaaccactacacgccatctctggacgaccaggcctccaccctacaacgaacggaccaaccgaaccaaaaacgnggtacgtacctaaacactacgaacctaaacacgtacggaaccccagtacggaacaacgacgaccaactactaacctactcgtacgaccacggaacgggtaggtcggcggtggggtacggtacgggaaccgttacgggtacggggacccgtaaggggtacgttcccggttcgggtacccgtaccggttcccgtacccgtaccgaccgtaccccgtacccgaaacccgggaaccgggtcccctaacggttccccggttaccccgttccccccggtcggggcccccgtccccgtcggtaccccgtcccggaaccgggtccctaccccggtacccgtaccgggaaccgacccgacccgaccggtaccccgggg

SEQ ID NO: 71911 - DNA, 706 bp, Homo sapiens
  misc_feature: GYAE6OF01CD1VL.21.26.C04.1.454.CMB.1.raw
  modified_base (679)..(679): a, c, t, g, unknown or other
  misc_feature (679)..(679): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtacgaaacccacagacgaccctcacgctgacctgctaccttctcgttgggttttcactcaacgtaccactgcgtaggtgggtggtgggctggactccggtaccgaccggacccccgggaaacggccccggaggtcggtcgttcgaccacttacgtaatttagtaggattagagtacgtaaactaacctactaccacgccctactcctacgtaggaccggaaccgacggtcctccaacccgtacgaacggaaccggaacctaacccgaaacccgaaaacgtagggtaccgtaacctaaaccgagtaccgaacctaaacgacgtacccggaaccctagacgacacgacacactatactacgtgacgacgtacgaggcgtggacggtgggtagcggtacgtacggtcggggacgtacggggtacgttccgtagggtccctaccggttccacccggtacacccgttcccgacccgtaagacccggtccgtacttccccgggtctccccggtgggcctccgtcgtcgacgacccggtacnccgtaccgcgaagcctcgacgtcccgg

SEQ ID NO: 71912 - DNA, 821 bp, Homo sapiens
  misc_feature: GYAE6OF01D9323.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagacgaccctcacgctgacctgctacctttctcgttcggttttcactcagtaccacgtgctaggtgggtggtggctggactccgcacggacccccggaacggcccggagtcgcttgactacttctaagtttagtaggaatgatacgaactaaccactacacgtccattcttcgacggaacggaccgacggtccctaccgtaccccgtaacgaaccggaaacggaaccccaaacccggaaaacccgaaaaaaacccggtcgggttaaccgttaacccctaaaaccgacccttacggaaacccaaacgtacgttacccggaaccccaggtacggaaccaccgaccgaacccaaacttactaacctaacgtcgtaccgaccgtaacgggaccgggagttcgggacggttaggggttcggtacgggtaccggttacgggtcggggaccggtagggtcccgttcggttaccggtccgtacccgtccgtccgacctacccggtccctaaccccgtaacggaacccgggtccccttaacgggtccccgtttacccccggtaccccccgggtcggacccccgttcccggtccggtcccgtacccgggaccgggtacccgaccccgtaaccccggttcccgggaataccccggccgaacgggtacccccgggg

SEQ ID NO: 71913 - DNA, 749 bp, Homo sapiens
  misc_feature: GYAE6OF01BHDYB.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgctaccttctcttgggttttcactcagtaccactgcaggtgggtgtgggctggactccgtcaccggaccccccgggaaacggccccgggaggtcggtcttcgcaccgtctatttagtggaatgatgaactaaccactacacgcccatctcgtgacggccacggcctacctacccgtacgaaccggaacggaacccgaaccccgaaacccgaaaaaccggtacgggttaccgtaccctaaccaaccgtacgaacccaacgacgtccggaaccccctagtccggaacaccgaccgaccaaccgtactaaccgtactcggtacgaccgaaccggacgggtacggtgggtaccgttgggggtacggtacgggtaccgtacgggtcgggaccggtaacggggtacgtcccggtacggtaccgtaccgtccttccgtaccgaccgtccctacccgaccgaccgggtccctaccggttccggtaccccgttccccgtaccggcccgtccgtaccgcccgttacccgaacggaccgtacccgtacccggtacgaaccggaccgtaccgaccgtacccgggg

SEQ ID NO: 71914 - DNA, 759 bp, Homo sapiens
  misc_feature: GYAE6OF01BYNON.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttggttttcactcacgtaccactgcgagtgggtggtggctggatccgtcaccggacccccggaaaggccccggagtggcttcgccactctatttagtaggaatgatagaactaaccactacgacaccctatctacgtggacggtaccgacggcctaccaccctacgaacgaacggaacccaacccgaaaccgaaaaaccgacggttaccgtaacctaaaccgaactaaccgaaaccaaacgacgtaccgaaccccgagtacggaaccaccgaaccgaccaacacttaacctagtcgacgacgaacgacgggtcgacgggtcgtagggttcggtacgggtacgtacgggtcgggaccgtagggtccgtaccgttacggtaccgtaccggtccttaccggaccgtaccgtccccgtacccgaacccggaaccggtacccggtacccgtttacccgggttccccgttccccggtccggtccccggtcccgttccggtacccccggttacccggaaccgggaccccgtacccgtaccccggtaaccggacgtacccggcccgaacccggtcccccggg

SEQ ID NO: 71915 - DNA, 797 bp, Homo sapiens
  misc_feature: GYAE6OF01B8ZQ4.21.26.C04.1.454.CMB.1.raw
  modified_base (229)..(229): a, c, t, g, unknown or other
  misc_feature (229)..(229): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctcggtcccacgctggtcgaaacccacagagaccctcacgctgcctacgccaccttctcgttggtttcactcacgtaccacgtgacaggtgggtaggngggtctggtactccgtcgaacccggaccccgggaacggccccggtagtcgtctgctactacgtattttacgtagtaatcgatacgtaactaaccgactacgacncctatccncgtacgacggacctcgccaccgtaccctacgaacggaacgaacccgaaccgaaaccgaaaaccggtcgtacctaaccgtaaacctcgtaccgtaaacaacgacgtaaccggaaccctagtaccgaccacgaaccgaccaactacgtacttaccggacgtaccgaccgaaacgggtgggacggttcggtacgggtagggttacgggtacggtaccgggtacgggttaacgggcccggtaaggttaccggccgggttaccgtccgacccttaccttccggtacccctcggtaccccgaacccgtaacgggaccccgggtaccttacccgggttccccggttaccccgtcccccgggtaccgggtcccctacccgggtacctcccggtaacgaacccggttaacccaccccggttaaccccgtacggaccgggtcccaacgggttcccggacccccggg

SEQ ID NO: 71916 - DNA, 697 bp, Homo sapiens
  misc_feature: GYAE6OF01E55RA.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagacgaccctcacgctgacctgctaccttctcttgggtttcactcacgtaccactgcgtaggtggggtgtgggcgtggactccgtccgaccggacccccgggaaacgggccccggagtcggtcgttgctactacttatttagtaggaatgtatagaactaaccactacgacgaccatctcgacgacggaccacggtcctaccgaccctacgaaccggaacgaaccgaacccgaaaccgaaaaccgtacgggtaccgtaacctaaccgacctacgaacccaagtaccgacgaacccgagtacgacacacacactactactcgtcgcacgaacggacgggtggtggtcggtgggtacggtacggtacggtacggtccgggacggtacgggtcgtcccgttcgaccctaccgttcctaccgccgtacgtcccgtaccgacccgtaccggacccgtcgtccccgtccttccccggaccgcccgtcccgtcgacccgcccggtacgcccgaccgtacccgtacgacggaccgccgccgtcccgggg

SEQ ID NO: 71917 - DNA, 762 bp, Homo sapiens
  misc_feature: GYAE6OF01B7CIU.21.26.C04.1.454.CMB.1.raw
  modified_base (369)..(369): a, c, t, g, unknown or other
  misc_feature (369)..(369): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtgtgggctggactccgtcaccggacccccggaaaggccccggagtcggcttcgcactctatttatggaatgatgataaccactacacgccatctcgtgacgaccgaggcctaccaccctacgaacgaacggaccaacccgaaccaaaaccgnggtacgtaccaacgactacgaaccaactacgtaccgacccagtacggacaacgacgaccaacacttactacgtcgtacgaccgaacggacgggtagtcggacggttggggtacgtacggggtaccttacgggacggggaccgtacggggtccgttcccggtcggtacccgtaccgttcccgttacccgtaccgtaccggtcccgtaacccccgaaccggtaacccgggtccctaaccgggttccccgggtttcccccgttaccccccgggtacggggccccccggttaccccgtacccggtaccccggttacccgggaaccggggtacccgtacccccgttacccgggtaccccggaaaggcccgggtacccaacccggggtaaccccggggg

SEQ ID NO: 71918 - DNA, 721 bp, Homo sapiens
  misc_feature: GYAE6OF01DPVEJ.21.26.C04.1.454.CMB.1.raw
  modified_base (713)..(713): a, c, t, g, unknown or other
  misc_feature (713)..(713): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctcggtcccacgctggtacgaaacccacagacgaccctcacgctgacctgctaccttctcgttggtttcactcacgtaccactgcgtaggtgggtggtgggcgtaggactcccgtcgaccccgggaaccccccgggtaaacgggccccggaggtcggtcgttcgacctacgttctattttagtggaatcgatacgtaaacctaacctactacgaccgtacctatcctcgtacggaccggaaccgacggtcctaccctaacccgtacgaaaccggaaccgaacccaacccgaaaaccgaaaaccgtcggtacgtaacccaacgacctacgaacctaacgtacgtacccggacctacgtacggaacaccgacgacctaactacgtactagtcgacgacgaacgggacgggtagtcgggtcggtgggtacggtacggtaccgtcgggacgggtacgacgggtccgttcgtcgggtacctcgttcctccacgtccctccgaccgaaccggtccgtccgtaccgttcccgtcccgtccggtccgcccgtccgacgtcccgcggacgccaccgtaccgagcgaacgccnggcccggg

SEQ ID NO: 71919 - DNA, 904 bp, Homo sapiens
  misc_feature: GYAE6OF01CAT2S.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctcggtcccacgctgggtacgaaacccacagacgaccctcacgctcgacctgcctaccttcgttcgtttcgggttttaccaccttacgaacgtaaccctacgtcgacgtagggttggggtgggtcgggtacgtcggaccttcccggtaccgaaccccgggaacccccccggggaaaaccgggccccgggtacgggttcggtccgttcggacctaccgttacttaacgtttttagttaacggtaaattacggtaactaacgtaaacctaaacccgtaactaaccgaccgtacccctagttccgtacggtacggtaaccggaaccgtccggtacctaccctaccccgtaacggaaacggaaaaccggaacccgaaaaccccggaaaacccgtaaaaaccggttacggggttaaccctaaacccgtaaacctaaccggtaaccgaaaccctaaacgtaaccggtaaccgaaccccgtaacgtaacggaacccaacgaaccacctaaacgtaacttaacgtaccgtagtaccggaaccaacggggtacggtagggttcgtcggggtagggtcggtacgggacgtacgggcggggacgtacggttacctcggtacgtacccgttcccggtccttacccggaccgaccgtaccccgtacccgaacgggttacccggccttaccggttcccgtccccgtcccggcgtccccgtaccggttcggaccctcgggaccgacccgtccgtaacccggtagaacgcccgacggtccggcccgggg

SEQ ID NO: 71920 - DNA, 765 bp, Homo sapiens
  misc_feature: GYAE6OF01C77UT.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctgggtagaaacccacagacgaccctcacgctgacctgcaccttctctgggttttcactcagtaccactgctaggtgggttgggctggactccgtcaccggacccccggaaacggccccggagtcggcttgcactctattagtggatgatgaactaaccactacacgaccatcctctggacggaccaggcctccaccctacacgaagaccaaccgaaccaaaacgcggtacgtaccctaacacctacgaaccaacagtccgaaccctagtacggaacacgacgaccaactactactacgtgtacacgacggacgggtaggtcggtcggttaggggtacggtacgggtaccgtacgggtacgggggacccggtaggggacgttccggtacgggtccctacccggtcccttacccgaccgtaacccggtcccccgtaaccgaacccgggtaaccgggtccccctacgggtttacccccgggtttccccctttaccccccgggccggggttccccgtaccccggttccggtaaccccgttacccgggaaccgggtcccgtaccccgttaaccccgggtacccggaaccgggacgaacccgacccgggtaacccgggtcccccggggg

SEQ ID NO: 71921 - DNA, 674 bp, Homo sapiens
  misc_feature: GYAE6OF01DA84W.21.26.C04.1.454.CMB.1.raw
  modified_base (320)..(320): a, c, t, g, unknown or other
  misc_feature (320)..(320): n is a, c, g, or t
  modified_base (488)..(488): a, c, t, g, unknown or other
  misc_feature (488)..(488): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (639)..(639): a, c, t, g, unknown or other
  misc_feature (639)..(639): n is a, c, g, or t
tcagtcgtcgctcgcacgaccggtgctcgatttagtctagcgactttggggtttgggggggaagaggaagactgacggtcctgctgctgaccatcccttcatgggtcttgtcccagatcaccttgaaggagtctggtcccagctggtagaacccacagagaccctacacgctgacctgcaccttctcttgggttttcactcagtaccactgcaggtgggtgtgggctggatccgtcaccgacccccgggaaacggccccggtagcggtcttgacctactctaattttaatgggtaaatgatgaactaaccactacgaacncccatctcgtaggaacggaccgaaggcctaccacccgtaccaacgaaacgggacaaacccgaaacccgaaaaaaccgtaggtacggtaaccctaaacaccttaacgaaaccaaacacgaccggaacccctagtacggaacacacgaaccactaactaacttagcgtanaccgaccgagggtagcggtgtgggagtggacctagtcggggaccgagggtacgccgtggaccacccgtctaccgtccacggtccctaccaaccggaaccgccctagtcccgtcccgtttccccgnggccncccgttagccctcgaaccggnaacccgtacccaacggacagacccgcggtaaccgg

SEQ ID NO: 71922 - DNA, 940 bp, Homo sapiens
  misc_feature: GYAE6OF01D9H11.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctcggtcccacgctcggtacgaaacccacagacgaccctcacgtctcggacctgcctacctttcttcgttgggttttccactctacgtacctactcgacgtggttggggtggtgggcgtaggactccgtaccgacccgggacccccggaaacgggccccggaggttcggtcttcggacctactacttagtttacttaggaagtggtactacgaaccttaacctacctaacgtaccacctacttcgttacgtacggaccggaccggtacgtcctacccgtaaccccttacggaacccggtaaacggtaaccccgaaaacccggaaacccgtaaaaaccggtaccgggttaaccgtaacccgttaaccgaacgtaaccgtaaaccgaaacggtaaccgtacccggaacccgtaacggttaacggaacccaaaccggtaccaacccgtaaccgtaacgttaaccgtaacgttacgtaccgggaaaccgtaccggggaacgggggtttacggtaccggggttacgggttacggggtaaccgggttaacggggttaccgtaacggggttccggggaacccggttaacgggtcccgggtttcgtacccgggttacccctacccggttcccgttcccgtaacccgacccggttacccggaaccccggttaacccggacccgggtacccgttacgggttcccccttcccggttaccccggggtcttccccccgggttacctccggtacccgcccgggaacccggtcccggtacccgtacccggaacggtaccgaccgtaccgacccggtacccggggg

SEQ ID NO: 71923 - DNA, 613 bp, Homo sapiens
  misc_feature: GYAE6OF01BXS5X.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcaccttctctgggttttcactcagtaccactgcaggtgggtgtgggctggatccgtcacgcccccggaaaggccccggagtcggcttgcactcatttattggaatgatgataaccactacagcccatctctgagaccagctcacctcacgaacggacaaccgaccaaaaaaccgnggtacggtacctaaacacgtacgaaccaaacacgtacggaccccatacggaacacacgaccaacactactaactgtacgacacgacggaggtggcgtgggtgtagggactacggtcggggccgaagggaccgtcgtggtcccgacgtccacctcgaccgcctacccgacgacggccctacgtccgttacgtccccgaggtcccgccgttcgcccttccggacggtacgaccctaccgtaccgacgtcgccacgtacccggg

SEQ ID NO: 71924 - DNA, 777 bp, Homo sapiens
  misc_feature: GYAE6OF01BZIAD.21.26.C04.1.454.CMB.1.raw
  modified_base (233)..(233): a, c, t, g, unknown or other
  misc_feature (233)..(233): n is a, c, g, or t
  modified_base (729)..(729): a, c, t, g, unknown or other
  misc_feature (729)..(729): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacggctgggtagaaacccacagacgaccctcacgctagacctgctaccttctcgttgggtttcactcagtaccacgtgcgaggtgggtggtggngtaggacttccgacaccggacccccggaaacgggccccggtagtggccttggactactacgtatttagttagatcgtatagaactaaccaactacgacgaccactctacgtcgaacggccgacgtcctccaacccgtacaacggaacgaaccaacccgaaacgtaaaaccgtgtacggtaaccaaacgtacgtaacgaaccgtaaagactaccggaaaccctaggacgaaccacacgaccaacgtactaacggtccgtaggtacgaaccgaacgggaaccgggttagggtaccgggtaggtacgggggttacgggtaccggggtaacgttacccggggtacggggtacccgtaacgggttacggttaccgttacgggttacctaccccgggttacttaccccgggaaccacggtacccccgttaaccgaacccgtaacggggtacccctaacggtccccgggtttacccgtccccgtacggccctaacccggtacnccggtaccgtacgacgtccgtacccgtacgacgcgtacgaccggtcgg

SEQ ID NO: 71925 - DNA, 857 bp, Homo sapiens
  misc_feature: GYAE6OF01CO59O.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcacccttctcttggtttcactcagtaccactgacagtgggtgtcgggctggactccgtacgaccggacccccccggaaaggcccccgggtagtcgggtcctttcggaccaccgttactaagtttttaagtttagggaaattggaataggtaaactaaaaccctaacctaacgaaccgaccccctacttccgtaccgttaggaacggaaccgtacgggcccttacccaaccccctaccgaaaccgaaccgggaaccaacccccggaaaacccgtaaaaaacccgacgggttaccgggtaaccctaaaacctaccgtaccggaaaccaaaaccgtaccgttaacgaacccccagtaccggaaccgaactaaccggacccaactaactaaccttacgtcggtacgaccgaccgtaacggggtaagttcggacggttaggggtgtaacgggtacgtacgggtacgggaccgtacggggtacgtaccgtcgggtacccgtacgttcccgtacctacgaaccgtcccgtaaccccgaccgggtaaaccggcccctaaccgtcccgggtttacccttacccccccgggtcgtacccccgtccccggtaccgtacccgtaccggaacggtacccgtaacccggtaacccgtacccggtaacgggacccgacccgtcccggaacccgggg

SEQ ID NO: 71926 - DNA, 696 bp, Homo sapiens
  misc_feature: GYAE6OF01E1VGZ.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtggctggatccgcgaccgacccccggaaacggccccggagtggcttcgcactctatttataggaatgatgtaactaaccactacacgcccatcctcgtgacggaccgaggcctaccaccctacaaccggaacggaccaacccggaaacccaaaaaccggcggtacggtaccctaaccaccgtacgaaccaaacacgtaccgaacccagtacggaccacacgaccactactacctatcgtcgaccgacggacgggtaggtggtcggttgggtagggtcgggaaccgttcggtcggggaccgtacgggtcgtaccggtcggtcccgtacccgttccttcccgtaccgaccggtccctacccgaacccggacccggtaccctaccggttcccgttacccgttcccccggtcggccccgtcccgtcgcccgttaccggaacggccgcctaaccccggcgaacgcgacccgcggtacccggg

SEQ ID NO: 71927 - DNA, 894 bp, Homo sapiens
  misc_feature: GYAE6OF01B3YPU.21.26.C04.1.454.CMB.1.raw
tcagtcgtcgctcgcacgaccggtgctcgatttagtctagcgactttgggtttggggggaagaggaagactgacggtcctgctgctgaccatcccttcagtgggtcttgtcccagatcaccttgaaggagtctcggtcccacgcgtggtacgaaacccacagacgaccctcacgtctcgacctgcctaccttctcgtttggtttcactcacgtaccactgacgtggtggggtgggtcggcgtggtaccgtccgaccggaccccggaacccccggggaaccgggcccccgggtaggcgggtccgttaccgacttacctacgttaagttttaggttaggtaagtaggtaactaacgtaacctaaaccctaactaacctccgacctactcgtacggtacggacgaccgacgtaccctacccaacccgtacgaacggaaaccgaaccgaacccgaaaccgtaaaccggtacggtaacccgtaacctaaaccgtaactaaccgaaccaacgtacgtacccgaacccgtaggtaaccggaaccaaccgtacccgaacccgtaactaaaccgttacctacgtaccgtaaccgaccggtaaaccggggtacggggtacggttcgggtaccgggttaggggtaccgggtaccggggtaccggtacggggtccggggtaaccgggttacgggtacccggtacccggttacggtacccgtacccgttaccctaccggtacccgtacccgtaccccgacccgtaacccgggacccgttacccgacccggtttacccgtccccccgtcccgggtccggtacccccgttcccgtacggtaccccggacccggtaccgggaccgtaccccggtaccgcggaacccgacggaccggcccggtaccccggg

SEQ ID NO: 71928 - DNA, 762 bp, Homo sapiens
  misc_feature: GYAE6OF01EV0SW.21.26.C04.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcacgcccccggaaaggccccggagtggcttgctactctatttagttggaatgatgactaaccactacagcccatccttctagacggaccaggcctccacctcaacgaacggaccaccgaaccaaaaaccgnggtacggtacctaacactacgaaccaacacgtcggaaccccagtcggaacacacgaccaacactaactacgtgtacgaccgaaccgacggggtaagtcggtccggttggggtacggttcggggtaacctttaacgggttcggggggacccgtaagggggtaccgggttcccgtttaacgggtcccttaacccggtcccgttacccgtaccggacccggtaccccgttaccccgaaacccggaaccggggtacccccgtacggtttaccccgggttcccccgtttacccccggtcccgggtacccggtcccccgtacggttccccggtaccccgtaccgggaccggtaccccgtacccgggttaccccgaacggacccggaccgtacccgtacccgggg

SEQ ID NO: 71929 - DNA, 1000 bp, Homo sapiens
  misc_feature: GYAE6OF01BI9LS.21.26.C04.1.454.CMB.1.raw
  modified_base (157)..(157): a, c, t, g, unknown or other
  misc_feature (157)..(157): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggatctcggtcccacgctggtacgaaacccanagacgaccctcacgctcgacctgacctacctttctcgtttggttttcacctactacgtaccacgtgtacgtagggttgggtggtcgggtcgtacggtacttccccggtacgaaccccgggacccccccggggtaaaacggggccccgggtaggttcggtccgtttcggaccttaccttacgtttacttttaaggttaacggtaaagttcgtaagttacgaaaaccttaaacccgaaacgttacccgaaccgtacccttaacgtccgtttaacggtacggggaaccggtaacccgacgggtccccttacccgaacccgttaaccgaacggggaaaccaacccgaaaaccccgaaaaccgtaaaaaccggtgggttaacccttaacccgtaaaccaaaccggttaaccgaaaacctaaccggtaacgttaaccccgggaaccctaaaggtccggaaaactacccggtaaccaaccgtaaaaccgttactaaccgttacgtaccgtaacgtaaccggaaccgggtacgggtacgggtagggttaccgggtacgggggtacgggttacgggtaacgggttaccgggtaccggggacccgggtaacgggttccgtccgggttaccggtaccccggtaccggttaccccgttaccgtaacggtaccccgtaccccgttaacccggtaaccggggtaacccgttaccccggtaccggtttccccggttacccccggttcccgttaccccgggtccccgttacccggtacccggaccggtttaaccggacccgggttacccacccgggtaaccgtacgggaccgtaccggaaacccgttcgggaccccggg

SEQ ID NO: 71930 - DNA, 806 bp, Homo sapiens
  misc_feature: GYAE6OF01C19PV.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagagaccctcacgctgacctgcaccttctcttgggttttcactcacgtaccactgcaggtgggtgtgggctggactccgtcaccggacccccgggaaacggtccccggaggttcggacttgaccactctaagttttatggaagtcgatgaactaacccactacacgaccatcgtctaggacggaccacggcctaccacctacaacggaacgaccgaacccaaacccaaaacgtggtaccgtaaccctaacactaccgaactaaacgagttacccgggaacccagtacggaaccacaaccgaccaaactacgttacctaacgtcggtacggacgtaaccggacggggttacgtacggggtggttacggggttcgggaccggggtttaaccgtaccggggtacgggggtaccgggaacggggtaccgttacccgggttaccgttacccgtacccgtttcccggtacccgttaccggacccgttaccccgtaccccgaaaccgggtaccccgggtacccgttaccgttcccccgggttccccgttcccccggtaccgggtccccggtacccgtcccggtaccggtcccggaaccggtaaccgccccgttaaacccgtaccggaacggacccggtaaccgccggaccccgggg

SEQ ID NO: 71931 - DNA, 784 bp, Homo sapiens
  misc_feature: GYAE6OF01A6DS0.21.26.C04.1.454.CMB.1.raw
  modified_base (156)..(156): a, c, t, g, unknown or other
  misc_feature (156)..(156): n is a, c, g, or t
  modified_base (197)..(197): a, c, t, g, unknown or other
  misc_feature (197)..(197): n is a, c, g, or t
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctgggtgaaacccanagagaccctcacgctgacctgcaccttctctggtttcactnacgtaccactgcaggtggtgtcgggctggactccgtacacggaccccccggaaaggccccggtagtcggcttgaccactctatttagtggtaacttggatacgtaactaacctacgtaacgacgtccctaatctagtcggacggaaaccncggtaccctacctaccccgacgaaccggaaacggacccaaacccgaaacccgtaaaaaccgtagggttaccggtaccccttaaacgaccgacaaacccaacgaaccgtcggaaccccctaagttaccgggaaccaaccgtaccggaaccctaactaacggtaaccttacgttacgacgtacgaaccggacgggtacgtccgggtcggttggggtacggtacggggaccggtacgggtcgggaacggtacgggttaccgtcccgttacgggtcccgtaccggttaccttcccgccggtacctcccggtaacccgaccgggtaaccggacccgttcgtccccgggtttacccctccccggtcgtacccccgtccggttccgaccgacccggtaggaacccgtcctacccggtaccgagtaccgacgaccggtacccggg

SEQ ID NO: 71932 - DNA, 619 bp, Homo sapiens
  misc_feature: GYAE6OF01BN3SY.21.26.C04.1.454.CMB.1.raw
  modified_base (455)..(455): a, c, t, g, unknown or other
  misc_feature (455)..(455): n is a, c, g, or t
  modified_base (522)..(522): a, c, t, g, unknown or other
  misc_feature (522)..(522): n is a, c, g, or t
  modified_base (566)..(566): a, c, t, g, unknown or other
  misc_feature (566)..(566): n is a, c, g, or t
  modified_base (606)..(606): a, c, t, g, unknown or other
  misc_feature (606)..(606): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtggtgggctggactccgtcgacgcccccggaaaggccccggagtggcttgcactctatttatggaatgatagactaaccactacacgcccatctcgtgacggaccaggcctccaccctacgacgaacggaccacccgaaccaaaacgtggtacgtacctaacactacgaccaacacgtacgaccccagtacgacacgacgaccactatactagtcgtacgacacggacggagtcggngtgggtaggtacggtacgtacggtcgggacgacgggtcgtcgtcggtccaccgttctccacgtaccnccgtaccgaccgaccgggcccagttcccggtcccttcccccggngccccgtcgtcgacctccggacgccgacctacccgcgganacgccgccgcggg

SEQ ID NO: 71933 - DNA, 956 bp, Homo sapiens
  misc_feature: GYAE6OF01BDTIQ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtccccaacgcgtggtacgaaacccacgagacgaccctcacgctgacctgctaccttcttcgttggttttactactctacgtaccacgtgacgtaggtgggtggtggtacgtcggtacgttcccggtaccgaacccgggaaccccccgggaaacgggtccccggtaggtcggtcttcggctaccgtacttattttacgttagggtaattcgtaatacgtaacttaaacccaacgtaaccgacggtaccctacgttaccgtcgacggtacgggaccgtaaccggtcctaaccccgtaacctaccggaaacgggaaaccgaacccgtaaacccgaaaaacccgtaaaaaccgtcggttaccgtaaacccgtaaaccgttaaccgaaacgaaaccccgtaaacgtaaccggtaacccggtaacccccgagttaacggacctaacccggaacccgtaacctaaaccgtacgtttaaaccctaccggttacgtacccgaaacggtaaccggggtaacgggttacgggtggtaccgggtttagggggtacgtaaacccggggttacgtccgggggttaccggggaccggtaacgggttccccgtacggttaccgggttaacccgtcccgggttaccctaccgtaaccggtaccccgttaccccgtaccgaaacccccgggttaacggaccccgttacccggttacccgggtttaccccccttccccggggttagtcccccccggttactacccggggtacccgtccgggaccgaaccccgtcccgttaacccggtacggacgttaccgaacccgggcgtacccccgggg

SEQ ID NO: 71934 - DNA, 846 bp, Homo sapiens
  misc_feature: GYAE6OF01DPTUI.21.26.C04.1.454.CMB.1.raw
  modified_base (130)..(130): a, c, t, g, unknown or other
  misc_feature (130)..(130): n is a, c, g, or t
  modified_base (159)..(159): a, c, t, g, unknown or other
  misc_feature (159)..(159): n is a, c, g, or t
  modified_base (221)..(221): a, c, t, g, unknown or other
  misc_feature (221)..(221): n is a, c, g, or t
tcagtcgtcgctcgcacgaccggtgctcgatttagtctagcgactttggggttggggggaagaggaagactgacggtcctgctgctgaccactcccttcatgggtcttgtcccagactcaccttgaaggngtctcggtcccacgctggtacgaaacccngagacgaccctcacgtctacgacctgacctaccttctcgttaggtttcactacgacgtaccncgtcgcgtggtggggtgtcgggactacggtctacccggtaccggaaccccgggacccccgggaaacgggtccccgggtaggttcggtccgttacgaccgttacttacgttaagttttaaggtaaggtacttcggtaacgttaacgtaaaccttaaccaactaccgaccgtaccctagtacgttacgtaacgggaaaccggtaccgccggttccctaaccgtaccccggtaaacgaaaccggaaacgtaaccccgtaaacccggaaaaaccctaaaccgggttagggtacccgtaaaccttaaaccggaccgttacgaaacccgttaacgaacgttacccgggaaaccctaggtaacggaacccaccgaaccgaaccgtaacttaccgttaaccgtacgtacggaccgtaaccggaacgggtacggtgggtacgggtacggtagggtacggtaccggtaacggtcggtacgggcccgtaaggtcccggtcgacgtcctaccgtccgacctccgaccgtacccgtaccgaaccggtcgtcccgtaacgttcccgtaccgcccgtccgccgtcctcgtacccggcgccgtaaccgccctaaggtcgaacgtcaacggtccgtaccggg

SEQ ID NO: 71935 - DNA, 904 bp, Homo sapiens
  misc_feature: GYAE6OF01CDSU6.21.26.C04.1.454.CMB.1.raw
  modified_base (130)..(130): a, c, t, g, unknown or other
  misc_feature (130)..(130): n is a, c, g, or t
tcagtcgtcgctcgcacgaccggtgctcgatttagtctagcgactttggggtttgggggggaagaggaagactgacggtcctgctgctgaccatcccttcatgggtcttgtcccagatcaccttgaaggngtctggtcccacgctggtacgaaacccacagacgaccctcacgctcgacctcgctaccttcttcgttcggtttcactctacgtaccacgtgcgtagggttcgggtggtacgggcgtcggtacctccggtaccgaccccgggaacccccggggaacgggccccgggtaggtccggtcgttcgacctacttacgtagttttaggtaggtaataggtactagtaaacctaaaccctaacgtaaccgaccgtccctattcgttacggacggaccggaccgaccggcctacccgtacccgtaccggaaacgaaccggaacccaaacccgaaaccgtaaaccggtacggtaaccgtaaccttaaccgacgaaccgaaaccgtaacaccggtacccggtaacccaaggtaccggaacccaacgtaccgaacctaacgtaacttacccgtacgtacgtaccggaacccggtacggggtaacgggttccggtggggttacgggttacgggggtacggggtaacgggttacccgggttaacgggggacccgggtaacgggttacgggtcccggttaccggttccgggtaccccgtacccgtcccgttaacccgccggtaccctaccccgtaccccgggtaaccgaccccggtacgttcccggttaccccggttccccgttccccggacccggtccgttccccggccggtaccgtaaccccggtacggccccttaacccggacccggtaacggtccggaacccgccggtccccggtacccggggg

SEQ ID NO: 71936 - DNA, 700 bp, Homo sapiens
  misc_feature: GYAE6OF01DD1GW.21.26.C04.1.454.CMB.1.raw
  modified_base (278)..(278): a, c, t, g, unknown or other
  misc_feature (278)..(278): n is a, c, g, or t
  modified_base (398)..(398): a, c, t, g, unknown or other
  misc_feature (398)..(398): n is a, c, g, or t
  modified_base (624)..(624): a, c, t, g, unknown or other
  misc_feature (624)..(624): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccacagagaccctcacgctgacctgcaccttctcttgggttttcactcagtaccactgcaggtgggtgtgggctggactccgtccgacggacccccgggaaaggccccggagtcggcttgctactntatttagtggaatgatagactaaccactacacgccatccttctaggacggaccgacggtcctccaccctacaacggaacggaccaaccgaaccaaaaccggcggttacgtaccctaaacncgtacaaccaaacacgtaccggaacccaagtacggaaccacgacgacccaactaacttaacctactcggtcaaccgtaacgggacggggtacgtcgggcggtagggtcggtaacgggtacacgggtcggggacgtaggggtcctcgttcggacctaccgtcgtacctcgaccggtccctaaccgaacggtaccgggtaccctacgttccggtcccgttcccccggnggtccccgtccgtacgtcccggtacccggaggtacccacccgtacccggtacgacgcgaccgtacggaccccgggg

SEQ ID NO: 71937 - DNA, 679 bp, Homo sapiens
  misc_feature: GYAE6OF01DI7K3.21.26.C04.1.454.CMB.1.raw
  modified_base (328)..(328): a, c, t, g, unknown or other
  misc_feature (328)..(328): n is a, c, g, or t
  modified_base (463)..(463): a, c, t, g, unknown or other
  misc_feature (463)..(463): n is a, c, g, or t
  modified_base (537)..(537): a, c, t, g, unknown or other
  misc_feature (537)..(537): n is a, c, g, or t
tcagtcgtcgctcgcacgaccggtgctcgatttagtctagcgactttgggtttggggggaagaggaagactgacggtcctgctgctgaccatcccttcatgggtctcgtcccagatcaccttgaaggagtctggtcccacgctggtacgaaacccacagagaccctcacgctgacctgcaccttctcgttggttttcactcacgtaccactgcaggtgggtgtcgggctggactcccgtcgaccggacccccggaaacggccccggagtcggcttgcactctatttacgtggaatgatacgaactaacctactacaccgccactcgtntaggacgaccgcgacctcccaaccctacgaacgaaccgaaccgaacccgaaaccgaaaaccgtcggtacgtacctaaactctacgaaccaacacgtaccgacccagtacgacacacgacctagtactacttacgngtacgcacggtacggaggtcgtggtgggtagtacggtacgtacggtcggggacgtgggtccgtcgtcggtaccnccgttcctccgtcgaccgtccgaccgaaccggtaccgcccgtacgttcccgtccccgtacccggtcgacccgccctacggtaccctcggaaccggtccgtacccctaccgggtaacaggaacccgccgacggtaccccgggg

SEQ ID NO: 71938 - DNA, 761 bp, Homo sapiens
  misc_feature: GYAE6OF01BCTNO.21.26.C04.1.454.CMB.1.raw
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgagaccagctcaccctnacgtaacggaccacgaccaaaaaccgnggtacggtacctaaacgactacgaacccaacacttacgggaacccccagttacggaacaaccacgggaccccaaaccacgttaacctaacgttcggtacgaccgaaccgacggggtacgttagggtccgttggggttcgggtacggggtaccttaccggttacgggggcccgtaacggggacgttccccgtgggtacctaaccccgggttccttacccgtaccgtaaccgtccccgttacccgaacccggtaaccgggtcccccaacggttcccgggttcccctttaacccccccggtcgggtaccccggtccccccgttacgggaccccttccccggtaaccgggacgaccccggtaacccccggttccccgggtaaccggtaccggcccgtaaacccggtaaccccgggg

SEQ ID NO: 71939 - DNA, 817 bp, Homo sapiens
  misc_feature: GYAE6OF01CSN2X.21.26.C04.1.454.CMB.1.raw
tcagtcgtcgctcgcacgaccggtgctcgatttagtctagcgactttgggtttgggggggaagaggaagactgacggtcctgctgctgaccatcccttcatggtcttgtcccagatcaccttgaaggagtctcggtcccacgctggtacgaaacccacaagacgaccctcacgctcgacctcgcctaccttcttcgttgggtttctactacacgtaccactagcgaggtgggtggtggtcgtggactccgtcgacccggacccccggaacggcccggaggtcggtctcgctactctatttagtaggaatgatagtaactaaccactaacaccaccgtactctcgtaggacgtaccgcgtcctaccaccgtacgaacggtaacgaaccaacccgaaccgaaaaccgtacggtaccgtaacctaaccgacgtaaccaaccgaacgtacgtaccgacccaagtacgaaccacaacgaaccacgtaactaaccgttacgtacgtaccgacgaaccgggtacgggtaacggtcggtacggttagggggtacgttaccggggacgttacggggtccggggtaaccggtaggggtaacccgttccgggtacgtaccccggtacccttccgtacccgtaccggaacccgtcccgtaaccccggtaacccggtaacccgggtcccgttaccgttaccccgggtttccccgttacccccgggcgggtacccccgttcccggtcccgttacccgggtaacccgacggggtcccgaacccccgttacccggacgggacccgtaccggaaccgtcccgggtacccggggg

SEQ ID NO: 71940 - DNA, 766 bp, Homo sapiens
  misc_feature: GYAE6OF01B2KAG.21.26.C04.1.454.CMB.1.raw
  modified_base (158)..(158): a, c, t, g, unknown or other
  misc_feature (158)..(158): n is a, c, g, or t
  modified_base (215)..(215): a, c, t, g, unknown or other
  misc_feature (215)..(215): n is a, c, g, or t
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtacccacggctggacgaaacccanagacgaccctcacgctcgactcgcaccttctcgttgggttttaccactcacgtaccnctgcgtaggtgggtggtgggctggactccgcaccggccccggaaggcccggngtggctgctactntattagttggatganagtactaaccgatacacgccctatcttacgaggacgaccacggcctaccacctcgaacggaacgacccgaaccgtaaaccaaaacgtcgggaccggtaacctaaccgaactacgaaaccgaactacgacccgaccacggtacgaaccacgacgacctacgtatacgtacgtgtacacgacgggtacggtaggtgggtcgtaggggacggttcgggacgtacgggtcggggaaccgtagggtccgttccggtccgtaaccggttcccttccgaccttacccggtaacccgtccccgtaaacccgggaaacccgacccgggttacccggttaaccgtccccggggtttaaacccccgttccccgggaccccgtacccgggtacccccgttcacccccgggtcggtaaaccggcccgttaccccggtaacccgtccggaaccggaacctaccgggcccgtttaaccccgggggg

SEQ ID NO: 71941 - DNA, 726 bp, Homo sapiens
  misc_feature: GYAE6OF01C76FI.21.26.C04.1.454.CMB.1.raw
  modified_base (322)..(322): a, c, t, g, unknown or other
  misc_feature (322)..(322): n is a, c, g, or t
  modified_base (469)..(469): a, c, t, g, unknown or other
  misc_feature (469)..(469): n is a, c, g, or t
  modified_base (564)..(564): a, c, t, g, unknown or other
  misc_feature (564)..(564): n is a, c, g, or t
  modified_base (631)..(631): a, c, t, g, unknown or other
  misc_feature (631)..(631): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtacgaaacccacagacgaccctcacgctgacctgctaccttctcgttggtttcactcacgtaccactgcaggtgggtgtcggcgtggactccgtccgaaccggacccccggaaggccccggagtcggcttgccgtactcttattagtggaatgatacgaactaacctacctacacncccgtatctcgtagacgtaccgagtcctacgacctacaacgaacgaccaccgtaaccaaaacgtggtacgtaactacacgtacgacaacacgacgaccagtacgaacgtacacgacacatactacgtagtacacgacggtaacgggntcggtaggtaggtcggtagtacccgaggtaccgggccgtagggtccgtaaccgttgggaccccgtaaccgggtttccctacggacccgttaaccnccccggtaaaccgtaacccgggtaccggtacccgtaccggttaccccggtttcccggtaacccccgnggggttcccctaaccggtcccgtacccgaacccgggacgtaccccggacccgtaaccccggacggtaacggccctacggggaaacccccgtcggg

SEQ ID NO: 71942 - DNA, 908 bp, Homo sapiens
  misc_feature: GYAE6OF01A995T.21.26.C04.1.454.CMB.1.raw
tcagtcgtcgctcgcacgaccggtgctcgatttagtctagcgactttgggtttggggggtaaggaggaagactgacggtcctgctgctgaccatcccttcatgggtcttgtcccagatcaccttgaaggagtctggtcccacgctggtgaaacccacagacgaccctcacgctgacctgccaccttctcgttgggttttcactcagtaccactgcaggtcggggtgtgggcgtggactccgtcgaccggacccccggaaacggccccggaggtcggcttcgaccgaccttacgtatttacgtaggtaactagtactacgtaaactaaccgtaacctaacgaccgtacctacgtccgttaccgtacggaccgtaccgaccgtaccgtacccgacccgtaaccgaaaccgggaaaccggaacccgaaaccccgtaaaacccgtaaaaaccggtacgggttaccgtaaccctaaaccgtaaccgtaaccgaaccctaaaccgtacggtaacccggtaaccccgtaacggtaccggaaacctaccgaccgaaccctaactaaccgttacgtaaccggtacgtaccggtaaccgtaaccgggtacgggtacgggtacgggtacgggttacggggttacgggtaccgggttacggtaccgggtaccggggtaccgggtaacgggtacccgttcggttaccggtacccgtacccggttcccgtacccgtacccgtacccgtaccccgtaaccccggtaaccggtaaccccgggtacccgttacccggttccccggtccccgttaccccgggtccggtaccccgtcccgtacccggtacccggtacccggtacccggtaccccgtacccggtaccccggtacccggaaccggacccggaaccgtaccggacccggg

SEQ ID NO: 71943 - DNA, 823 bp, Homo sapiens
  misc_feature: GYAE6OF01DY20Y.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagacgaccctcacgctcgacctcgctaccttctcttggttttcactcagtaccactgcaggtggggtggtgggctggtactccgtaccgaccggaccccccgggaaacgggccccggtaggtcggcgttcgactactactattttaagttaggaagtagatagaactaaccaactacacgccactctcgtagacggtaaccgacggtacctcccacccgtaccaacggaaacggaacccgaaccccgaaccgaaaaacccgtacggtaccgtaaccctaaccgtaacctaacgaaacccaaacgtacgtaccggaacccctaaggtaccgaacgaaccgtaaccgacccaacgtaaccttaacgttaaccgtcggtaaccggacccgaaaccgggacggggtacggtacgggtcgttagggggtggtacggggtaccgtacgggtcggggaccgtaggggtccttaccggttcggtccgtacccgtcctacccgtacgtacccgtaccccgtacccgaaccggacccggcccttaacccggttcccccggttacccgttcccccccgggcggtcccccgaccccgttacggtccccgtacggaaccgggtccgacccgttaaccccgtaccgggaaacgtacccgggtacgccccgggtacccggg

SEQ ID NO: 71944 - DNA, 561 bp, Homo sapiens
  misc_feature: GYAE6OF01AYK5H.21.26.C04.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaaggccccggagtggcttgcactcatttatggaatgatgataaccactacagcccatctctgaggaccaggctcaccctcacgaaggaccaccgaccaaaaaccnggtcggtacctaacactgaccaacatacggaccccatcggacacagccacactactactgtgcacgacgggagtggacgtgggtgtggacgtacgtggggccgagggacgtcgtggtccaccgtctcctcgacgcctccaccgaacggcccatccggtccttccccgtgcccgtccctgcctccgacgcgccgacctacgagcgtcgacgaccgg

SEQ ID NO: 71945 - DNA, 707 bp, Homo sapiens
  misc_feature: GYAE6OF01ES5LJ.21.26.C04.1.454.CMB.1.raw
  modified_base (362)..(362): a, c, t, g, unknown or other
  misc_feature (362)..(362): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtgtggctggatccgtcacgcccccggaaaggccccggagtggcttgcactctatttagtggaatgatgaactaaccactacacgccctatctctgacggaccaggtcctccaccctacgacgaacgaccaaccgaaccaaaacgnggtacgtacctaacactacgaaccaacacgtccggaccccagtacgacaccagacccactaactactactgacgaccgacgacgggtacgtggtacgtgggtcgtacggacgtacggtcggggaccgtagggtccgtccgttcggtccgtacccgttccgtacccgtacgtaccgtacccgtaccgtaacccggaaccgggtacccctccggttacccgggttcccccttaccccccgggtacgggtccccgtacccccggttcggtacccccgtccggaacgggtaccccgtaccccgtacccggtacccggaaccggtaccggacccgaccggtaccccgggg

SEQ ID NO: 71946 - DNA, 728 bp, Homo sapiens
  misc_feature: GYAE6OF01BCME3.21.26.C04.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (364)..(364): a, c, t, g, unknown or other
  misc_feature (364)..(364): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgatctgcaccttctcgttggttttcactcacgtaccactgcaggtgggtggtgggctggatccgtcgaccggacccccggaaacggcccggagtcggcttgcactctatttatggaatgatgaataaccactanacgccatctctggagaccgnggcctccacctacgacgagaccaacccgaccaaaaccgnggtacggtacctaaacgactacgaccaacataccggacccctagacgaccaacacgaccaccgtaactaactacgtgtacgcacggaacgggtggtcggtcgtagggtgggtacgggtaccgttacgggtcgggtacggaacggggtacggtcccggttccgggtacgtaacccgggttcccgtacccgtaccggtacccgtacccgttaaccccgaacccgggtaaccgggcccccgtaacggtttccccggttaccccgttcccccgggttaccgggccccgttcccccgttaccggcccgttacccggacgggacccgtacccgtaccccgtaaccggacggaccgcccggtaaccccggg

SEQ ID NO: 71947 - DNA, 762 bp, Homo sapiens
  misc_feature: GYAE6OF01E1H4S.21.26.C04.1.454.CMB.1.raw
  modified_base (447)..(447): a, c, t, g, unknown or other
  misc_feature (447)..(447): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgcctggtgaaacccacagacgaccctcacgctgacctgcaccttctcttgggtttccactcagtaccactgcaggtgggtgtggctggactccgtcaccggacccccggaaggccccggagtcggacttgacgtactactatttataggaatgtagtacgaactaaccactacgacgtcccatctcgtcggacggaccgacggcctacccgaccctacgaaccgtaacggacccaacccgtaacccgaaaaaccgtgggtaccggtaacctaccaacgtccgaaccaacgacgtccggaacccgtanacggtacaccgacgaccactaactaactacgtggtaccagtaaccggacgggtagtcgggacggttagggtcggtaccgggaaccgtacgggtaccgggacggtaacggggtacctacccgttggtacccgtaacccgttccctaccgtaccgtacccggtcccctaacccgaccggtaaccgggccccttaacgtccccggttaccccgtccccccgtacgggccccgttaccccgtgtacccccgttaccggaccgggtaccctccccgtaacccccggtagtaaccggacccgtacgacccggtaccccggg

SEQ ID NO: 71948 - DNA, 744 bp, Homo sapiens
  misc_feature: GYAE6OF01D6GJ0.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcaccttctcgttgggttttcactcagtaccactgcaggtgggtgtgggctggactccgtcgaccggacccccggaaggccccggagtcggcttgcactctatttatggaatgatgaactaaccactacacgcctatctcgtaggacggaccaggtcctaccacccgtacgaacggaacggaccaacccgaaccgaaaaacctagggtacggttaccctaacaccgtacgaaccaacgacgtaccggaaccccagtacggaaccaacgacgacccaaacgtaacttaaccgtactacggtacgaccgaaccggaacggggtagttcgggtcgttggggtaggtaccgggtaccgtacgggtcgggggaccggtacggggtccggttacccgtcgggtacccgtccgttaccgttcccgtactacccggtcccctacccgaacccggtaacgggtaccccgtacgttccccggttcccgttcccccgacgggttccccgcccgttccggaccgttcccgaacgggtccaccccgtacccgtaccggacgaccgccgaccggtacccggg

SEQ ID NO: 71949 - DNA, 634 bp, Homo sapiens
  misc_feature: GYAE6OF01CB5CR.21.26.C04.1.454.CMB.1.raw
  modified_base (384)..(384): a, c, t, g, unknown or other
  misc_feature (384)..(384): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacgacccccggaaggcccggagtgcttgcactcatttatggaatgatgaactaaccactacacgccatctctgaggaccaggctccacctcgacgaacgaccaaccgaccaaaaccgaggtacgtaccaaacactgaaccaacatcgacccancggacacacgccaacatactactgtacgacacggaggacggtggacgtgggtggtacgggactacgggtacggggaccgagggtacgttccgtcgggtacccgaccggttcctccgtacgccgtaccctcccacccggtaaccggccctacgtcccggttcccgttccccgtcgggcccgtccccgtgtaccccgtccgaacgggaccacccgtacccgttacggacgaccggtccaaccggtacccggg

SEQ ID NO: 71950 - DNA, 673 bp, Homo sapiens
  misc_feature: GYAE6OF01AW3V7.21.26.C04.1.454.CMB.1.raw
  modified_base (291)..(291): a, c, t, g, unknown or other
  misc_feature (291)..(291): n is a, c, g, or t
  modified_base (373)..(373): a, c, t, g, unknown or other
  misc_feature (373)..(373): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggtttcactcagtaccactgcaggtgggtgtgggctggactccgtcacggaccccccggaaaggccccggagtcggtcttgcactctatttagtggatgatnactaaccactacacgccatctcgtacggacggaccaggcctaccaccctacgaacgaaggaccaacccgaaccaaaaaccgnggtacgtacctaacacgtacgaaccaacgaagtccgaaccccgtatacggacccacacgaaccaactaacttacctaacgtggtaccgacaccgggaacgggtaggtcgggacggttggggtacggtacgggtaccgtacgggtcgggaccgagggtacgtccgtacggtcctaccttctacctacgccgtaccaccgtaccgaacgggtcccacgttccgttcccgtccccgacggcccgtcccgtcgtaccgtaccgacggtaccgcctacccgtacggacacgccacggtacccggg

SEQ ID NO: 71951 - DNA, 825 bp, Homo sapiens
  misc_feature: GYAE6OF01EN41P.21.26.C04.1.454.CMB.1.raw
  modified_base (659)..(659): a, c, t, g, unknown or other
  misc_feature (659)..(659): n is a, c, g, or t
  modified_base (804)..(804): a, c, t, g, unknown or other
  misc_feature (804)..(804): n is a, c, g, or t
tcagtcgtcgctcgcacgaccggtgctcgatttagtctagcgactttgggttgggggaagaggaagactgacggtcctgctgctgaccatcccttcagtgggtcttgtcccagatctaccttgaaggagtctcggtcccacgctggtacgaaacccacgagacgaccctcacgctcgacctgcctacctttctcgtttggtttccactaccgtacgtaccacgttcggcgtagggttgggtggtcgggtacgtaggtaccgttcccggtccgaacccgggaaccccccgggaaacggccccgggtaaggttcggtacgttcgtaccgtacttacgttagtttagttacggaagttgtaagtacgtaaacctaaacctaccgtaaccgtaccgtacccgtatccgttaccgtacggaaccggaaccgtccggtcccctaccctaccccgtacggaacccggtaaccgaacccgaaccccgaaacccgtaaaaacggtcggtaccgtaacctaaccgacgaccgtaaacccagtaacccggtaccggtaaacccacggtaccggaactacccggaaccaaccgaacttaccgtaacgtcgtacgtacaccgtaacggacggtaggtcgtcggagggtcgtacggcgttacggcgggtacgnggtccgtcgtcgaccgtccgtccgtacgtacccgcgtacccgaacccgtacccggaacgtacccgtcccgtcccggttaccccgtccgtacccggtccgtccgtaccgtccggaccgaccggtccgtaacccgtcccgaacggtnaaccggtccgccgtacccggg

SEQ ID NO: 71952 - DNA, 769 bp, Homo sapiens
  misc_feature: GYAE6OF01DU0GI.21.26.C04.1.454.CMB.1.raw
tcagtcgtcgctcgcacgaccggtgctcgatttagtctagcgactttgggtttggggggaagaggaagactgacggtcctgctgctgaccatccttcatgggtcttgtcccagatcaccttgaaggagtctcggtcccacggcgtggtacgaaacccacgagacgaccctcacgctcgacctgacctacctttcgtcgttgggttttacactcgaacgtaccacgtgcgtagggtggggtcggtcgggtctggctccggtaccgaccggacccccgggaacggcccgggtagtcggtctcgcctacttcgttaactttaggtaaggtagtgaatacgtaactaaaccacgtacacgtcctattccgtacgtacgggtacgacgtaccgcctacctacccacggtaaccggaaacgacccaaacccgaaaccgtaaaacggtcggtaccgtaacctaaccgtactaacgaaccaacgcgtaaccgaaccctaaggtcggaactaccgacgacccaatacgtaaccgttagcgtacgaacgcggacggtcgtcgggtaggtcgggtcggtaacggtcggtaccgggtcgggtaacggcgggttaccgtcggtacgtccgtaccgtccgttaccgacctaccgtcccgaccgaaccgacggtcccgtaccgttcccgtcccgttacccgtccggcccttcccggtacctacgtaccgggtaccgacggtacccgaccggtaacgggaacgtaccggccgaacgggtcccggg

SEQ ID NO: 71953 - DNA, 775 bp, Homo sapiens
  misc_feature: GYAE6OF01CE72L.21.26.C04.1.454.CMB.1.raw
  modified_base (226)..(226): a, c, t, g, unknown or other
  misc_feature (226)..(226): n is a, c, g, or t
  modified_base (378)..(378): a, c, t, g, unknown or other
  misc_feature (378)..(378): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctcgggtcccacgcctgggtacgaaacccacagacgacccctcacgctcgacctgcctaccttctcgttgggttttcactcacgtaccactgcgnggtggggtggtgggctaggtactccgtccgacccggacccccgggaaacgggccccggtaggtcggtcttcggactaccgttacttagttttaagtaggtaactggtaatacgaacctaacctactacacctccctatcgtcgcgacggacncgtccaccacccgacgaacgaacgtaaccaacccgaaaccgaaaacgcggtaccgtaacctaacgcctaacgaaccaaacgaccgtaccggtaacccaaggaccgaacaaccgacgtacctaaacgtacttaccgtacgtacgtaccggaaccgaaccggtaaggacggggtcggtcggtggggtacgtacgggacggtcgggtacgggacggacgggttcgtccgtacgtctaccggtccttaccgccgaccgtaccctacccgaacgacccggtcccgtaccggttccccggtccccgttacccggccggtccccgtccgtccgtccctaacccgggaccgaccggaccccgtaccgggaccggtaaccgaccggtaccgacccggggtcccggg

SEQ ID NO: 71954 - DNA, 802 bp, Homo sapiens
  misc_feature: GYAE6OF01D8ZZ2.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctaggtacgaaacccatagagaccctcacgctgacctgctacctttctcgttgggttttcactctacgtaccactgcgaggtgggtgtgggctggacgtccgtcgaccggacccccgggaaaggccccgggtagtcggcttcgacctactctatttagtaggaatgatgaactaaccacgtacacgtccctatccgtacgtggaacggaccgtacggtcctaccaccctacgaaccggtaacggaaccaacccgaaaccgaaaaaccgtcgggttaccggtaacctaacgaccgttacgaacctaacgtacgtaccggaccccgagtacggaacaccgacgtaccaacgtaatactaacgtcgtacgacacggtacgggtagtacggtcgttagggttgggacggtacgttacgggtcgggggacctagggggtccttccgggttcggtaccctacccggttcctacccgtaccgaccgtaccccgttacccgaaaccgggtaaccggtccccggttaacgttcccccggttaccccgtttcccccgggtacggtcccccggttacccgtaccggtacccctacccgggtaacggggacccgttacccccgtaccccggttaacccgggagttaaccccgggccgtaacccggtacccgggg

SEQ ID NO: 71955 - DNA, 643 bp, Homo sapiens
  misc_feature: GYAE6OF01CQJPK.21.26.C04.1.454.CMB.1.raw
  modified_base (311)..(311): a, c, t, g, unknown or other
  misc_feature (311)..(311): n is a, c, g, or t
  modified_base (501)..(501): a, c, t, g, unknown or other
  misc_feature (501)..(501): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcaccgacccccggaaacggccccggagtcggcttgcactctatttatggaatgatagataaccactacagccatctcngacgacgagcctcacctacaacgaacggacaaccgaaccaaaaccaggtacgtacaacactacgaaccaacagtacgaacccagtacgacacacgaccaacatactactgtacgacaccggaggtacgtcggacgttagggtaggtacggtactacgggtcgggaccgagggtacgtccgtcggtacccnccgtactcccgtacaccgtccctaccgaaccgtaacggcccgtacgtccccggttaccttccccggccgtcccgtacccgtccgtaccgttacccgaacggccgacccgacccgtaaccgacgacaccgtaccgaacccggg

SEQ ID NO: 71956 - DNA, 720 bp, Homo sapiens
  misc_feature: GYAE6OF01BNBR2.21.26.C04.1.454.CMB.1.raw
  modified_base (395)..(395): a, c, t, g, unknown or other
  misc_feature (395)..(395): n is a, c, g, or t
  modified_base (480)..(480): a, c, t, g, unknown or other
  misc_feature (480)..(480): n is a, c, g, or t
  modified_base (501)..(501): a, c, t, g, unknown or other
  misc_feature (501)..(501): n is a, c, g, or t
  modified_base (695)..(695): a, c, t, g, unknown or other
  misc_feature (695)..(695): n is a, c, g, or t
tcagtcgtcgctcgcacgaccggtgctcgatttagtctagcgactttgggtttgggggaagacggaagactgacggtcctgctgctgaccagtcccttcatgggtcttgtcccagatcaccttgaaggagtctggtcccacgctggtcgaaacccacagacgaccctcacgctgacctgcacctttctcgttgggttttcacttcagtaccactgctaggtgggtggtggctggactccgtcacggacccccggaaaggccccggagtcggccttaggcctacgtctattttagtacggaattgattgaaactacccacgtaacacggccctattctctaggacggaccacggcctccaaccgtgacggaacggtccaaccgaaccgaaaaaccngggttcgtaccctaaacgaccgtacgaaccaaacgtcgtaccgaacccaggtacgaaccaacacggtccaacgtatactacggtntcgaccgaacgacgggtacgnggaccgttggggtctaccgggggtatcccgggttaaggggccgtaacggggactttcccgggtaggtcccgaaccgttcctccccgttaacgccggttaccccggaccctaacccgggacggtcccacgggtccccggttcctacccccggtaggcccccgtacttccgctcccggagtaccgaacgtccccgngaaccggtcacgcggtaaccccggg

SEQ ID NO: 71957 - DNA, 773 bp, Homo sapiens
  misc_feature: GYAE6OF01CY2QZ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctgacctgccaccttctcgttggttttcactcagtaccactgcgaggtgggtggtgggcctggactccgtcgaaccggaccccccggtaaacggccccggagtcggtctcgcactctatttagtggaatcgatcgaactaaccactacacgcccactctactcggacgtaccgagtcctccacccgtacgaaccggaaacgacccgaaccccgtaaaccgaaaaccgtagggttaccggtaccaaaccgtacctacgaaacctaaacgacgtaccggaaccctaagacggaaccacgtacgacctaactaacgtaccttacgcggtacgaccgaacgggtacgggattaacgggtccggttggggtaccggtacggtaacccgtacgggttcggggaccgtaacggggtcgtttacccgtagggttaccccgaccgtttacgaccccttacgacccggtacccttacccgaaaccgggtacccggcccttaacgggtttcccccggtaccccttcccggggacccgtccccgtcccggttcgaccccgttacggaacccggtcgccccgtaccggtaccgaacgccgtaaccgcgaccccgggg

SEQ ID NO: 71958 - DNA, 918 bp, Homo sapiens
  misc_feature: GYAE6OF01COJE5.21.26.C04.1.454.CMB.1.raw
  modified_base (97)..(97): a, c, t, g, unknown or other
  misc_feature (97)..(97): n is a, c, g, or t
  modified_base (128)..(128): a, c, t, g, unknown or other
  misc_feature (128)..(128): n is a, c, g, or t
  modified_base (829)..(829): a, c, t, g, unknown or other
  misc_feature (829)..(829): n is a, c, g, or t
  modified_base (900)..(900): a, c, t, g, unknown or other
  misc_feature (900)..(900): n is a, c, g, or t
tcagtcgtcgctcgcacgaccggtgctcgatttagtctagcgactttgggtttgggggaagaggaagactgacggtcctgctgctgaccatcccttnagtgggtcttgtcccagatcaccttgaaggngtactcggtcccacgctcggtcgaaacccaacgagacgaccctcacgcgtcgacctgacctaccttctcgttacggtttccactcgacgtacccacgtcgtacgtacgggttgggtttcgggaccttggtaaccgtccggtacccgaaccccggggaccccccgggtaaaaccggtccccgggtaaggtccggttccgtttacggaaccgtaccttcgttaaagttttacgtacggtaagtacgtacgtaacgtaaaccctaaccgtaaccttaccgaacccgttcctaacgttccgtacgtaacggaaccggaacccgttacgggtacccctacccgtaaccccggtaacgtaaccgggaaacccggtaaccctaaaccccggaaaacccgtaaaaaccgggttcggttaccgttaaacccaaccgttacccgtaaacgaaccccgtaacgaacccgggttaaacccggaccccgttaaggtaacccggaaccctaaccggtaccgaaccccttaaacgtacgttaacccttacgttcgaaccggtacccggaaggtaccggggttacgtcgggtacggttagggtacggtacggtaccgtccggggacggtaccggtacggtcgttcgtaccggtccttacccgttccacgtccgacgacccctacccgaccgaacccggtcctaccggggtttacccncccgtttcccggccgtaccgtccgtaccgtaccggcgacgtccccggacttacccggacgacggttaaccncccgacggtccgcccggg

SEQ ID NO: 71959 - DNA, 757 bp, Homo sapiens
  misc_feature: GYAE6OF01AJAHT.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctgatcccacgctggtcgaaacccacagacgaccctcacactgacctgcaccttctcttgggttttcactcagtaccactgcagtgggtgtgggctggactccgtcacggcccccggaaggccccggagtggcttgcactctatttatggaatgatgaactaaccactacacgccctatcctcgtaggacggaccaggcctaccacccgtacgaacgaacggacccaacccgaacccaaaaaccgagacgtacggtacctaaacaccgtacgaacccaaacgacgtaccggaaccccacgtacggaccaaccgacgaccctaacgaacttacctacgtacggtacgacccgtaacgacggggtacggtacgggtccggttaggggttacgggtacggggtaaccgttacggggtacgggggacccggtagggggtaccgtcccggttcggtacccgtacccggttcccgttacccgtacgtacccggtcccctacccggaacccggaaccgggtaccccctcggttccccgggttaccccgtttcccccggacgggtcccccggtcccctcggtccccgtaccggacgggtacccgacccaacccgtcccggaagccggaaccccgg

SEQ ID NO: 71960 - DNA, 751 bp, Homo sapiens
  misc_feature: GYAE6OF01CLZ6P.21.26.C04.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggactccgtcaccggaccccccgggaaaggcccccggagtggtcttgacactctatttagtggaatgatagactaaaccactacacgccctatcctcgtggacgacacggcctaccacctacgaacggaacgaccaacccgaaccaaaacgngggtaccgtacctaacactacgaaccaactacgtaccgaacccagtacgaaccacacaccaactacttaacctacgtcgtacgaccgaacggtaacggggtagtacggtcggtaggggttacggtacgggtaccgttaacgggtcgggggtacccggtaggggtacccgttccggtaccggtacccgtaccggtttccctacccgttaccgaccgttaccccgttacccgaacccgggaccgggtaccctaccggttccccggttaccccgttcccccgggtaggtcccccgtacccgtggtaccccggttacccggacggacccgtaccccgtacccggaacccggaggacccgtaccgacccggtaccccggg

SEQ ID NO: 71961 - DNA, 718 bp, Homo sapiens
  misc_feature: GYAE6OF01EPSAL.21.26.C04.1.454.CMB.1.raw
  modified_base (337)..(337): a, c, t, g, unknown or other
  misc_feature (337)..(337): n is a, c, g, or t
  modified_base (474)..(474): a, c, t, g, unknown or other
  misc_feature (474)..(474): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcacctttctcgtggttttccactcacgtaccacgtgcgtaggtgggtgtcgggctggacgtcccgtcaccggaccccccggaaacggccccggagtcggcttgctactctatttagtagatgatagtactaaccactacacgcccatctcgtagacggacncggtccacctaccctacgaacggaaacggaccaaccccgaaccgaaaaaccgtcgggttacgtacccgtaaaccaccgtacgaaaccaacgtacgtacgacccgagtacgacacacgcccactagtacctacgtacncgaccacggtacgggtacgtcggtacgttcggggtagggttaccggtaacgtcgggtacgggtcgtaggggtaccgttccggtaccggtccggtaacccgtcgtcccgccgaccgtcccttaacccgaaccgtacccgggtaccacccggttccggtaccccgttccccggtacggtcccgcccgttacgacccggtccgacggtccgacccctacccggacgaagccgtacgcggtacccggg

SEQ ID NO: 71962 - DNA, 315 bp, Homo sapiens
  misc_feature: GYAE6OF01BBYOY.21.26.C04.1.454.CMB.1.raw
  modified_base (271)..(315): a, c, t, g, unknown or other
  misc_feature (271)..(315): n is a, c, g, or t
tcagtcgtcgctcgcacgaccggtgctcgatttagtctagcgactttgggtttgggggggaagaggaagactgacggtcctgctgctgaccactcccttcatgggtcttgtcccagatcacttgaaggagtctggtcccacgctggtacgaaacccacacgacgccctcacgctgacctcgctacctttccttcgttgggtttcacctctacgtaccactgcgagggttgggtggtggtcagccgtccgccgaccggaccccgggaacccnnnnnnnnnnnnnnnnnnnnnnnnnnnnnnnnnnnnnnnnnnnnn

SEQ ID NO: 71963 - DNA, 693 bp, Homo sapiens
  misc_feature: GYAE6OF01BV3IP.21.26.C04.1.454.CMB.1.raw
  modified_base (155)..(155): a, c, t, g, unknown or other
  misc_feature (155)..(155): n is a, c, g, or t
  modified_base (392)..(392): a, c, t, g, unknown or other
  misc_feature (392)..(392): n is a, c, g, or t
  modified_base (457)..(457): a, c, t, g, unknown or other
  misc_feature (457)..(457): n is a, c, g, or t
  modified_base (475)..(475): a, c, t, g, unknown or other
  misc_feature (475)..(475): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggatctggtcccacgctggtacgaaacccanagacgaccctcacgctgacctgctaccttctcgttggtttccactcacgtaccactgcgaggtgggtgtgggctggactccgtccgaccggaccccgaaggtccccgagtcgcttgacctactactatttagtaggatagactagaactaaccactacacgacccatcctacgtggacgtaccgacggtcctaccacccgtacgaaccggaacgacccaaccgaaaccgtaaaacgnggtaaccgtaccaaccgtcacgaaccacacgtccgacccagcgactacacgtacacactactcgntcgactagcgggtatcgnggtgtcgcggatccgggaggaccgaggtccgtccgtagtccgtaccgcctaccgacgtaccacccgttaccgaaccgggtccgtaccccgtacggtttccccgtcccgtttcccccggacggttccccgtaccccgtcgtaccccggtaacccggagggttaacccccgccgtaacccggtcccggaaaggttccccgccggtacggtacccccgggg

SEQ ID NO: 71964 - DNA, 715 bp, Homo sapiens
  misc_feature: GYAE6OF01CPSFO.21.26.C04.1.454.CMB.1.raw
  modified_base (360)..(360): a, c, t, g, unknown or other
  misc_feature (360)..(360): n is a, c, g, or t
  modified_base (458)..(458): a, c, t, g, unknown or other
  misc_feature (458)..(458): n is a, c, g, or t
  modified_base (468)..(468): a, c, t, g, unknown or other
  misc_feature (468)..(468): n is a, c, g, or t
  modified_base (592)..(592): a, c, t, g, unknown or other
  misc_feature (592)..(592): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgctaccttctcttgggtttcactcagtaccactgcaggtcgggtggtgggcgtggtacgtccgtaccgaccggaccccccggaaacgggccccggaggtcggtccttcgaccacgtctaattttagttaggaatggatagaactaaccgactacgaacgtcctactctacgtacgacggaacccncggtacctcccgaaccctaccgaaccggaacggaccgaaccccgaaacctaaaaccggtggtaccgtacctaacacgtacgaacacacgacgacccgngtacgacacncgaccacgtactactacgtcgagaccgacggacggtacggtggtaccggtgggtaggtacccggtaacgtacgggtcggggaccgtaggggtcgtcccgtggtaccctaccgtccctaccggtncccgtaccctaccgaacccggtacgggcctaccggttcccggttaccccttccccggacgggtccctcccgtgtccccgagtaccgcggttcccaccggccgacgtaccgcgtacgccccggg

SEQ ID NO: 71965 - DNA, 718 bp, Homo sapiens
  misc_feature: GYAE6OF01A1IT8.21.26.C04.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagtctagcgactttgggtttgggggaagacggaagactgacggtcctgctgctgaccatcccttcatgggtcttgtcccagatcaccttgaaggatctggtcccacgctacggtacgaaacccacacgacgaccctacacgctgacctgacctaccttctcgttggtttccactcacgtaccactgctaggtcggtggtcggctcggtactccgacgtaccggacccccgggaaaggccccggtagtcggtcttgacctacttcttatttagtagatcgtatcgaactaacctactacgacnccgtactcgtcgtaggaccgactacgacctcctaccgtacgaacggacgaccaacccgaaacgaaacggtcggttaccgtaacctaacaccgtacgaaaccaacgtacgtaacccggaccctacgtacgaccgaacgtaccgtaccaactacctacgtactcggtacgaccgtaaggccggtaaggtccgtagggtcggtaggtaccggtacgtacggtcgggtaacgcgggtaaccgtcgtacgtccgaccgtccgacctcgacccgtaccgacgacccggtacgccctacggtccccgtcctcccggtacgccccgtacgtccgtaccgacggtacgaccgtacccggtaccgacaaccgggtcaacccggtcgacccggg

SEQ ID NO: 71966 - DNA, 897 bp, Homo sapiens
  misc_feature: GYAE6OF01BSLMI.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctgggtacgaaacccacagacgaccctcacgctgacctgctaccttcttcgttcgggttttcactcacgtaccactgcgaggtgggtggtgggctggactccgtacgaccggacccccggaacggcccggagtggtcttcgcactctagtttagtaggtaatgatacgaactaaccgtactaaccgacgtacccgacttccgtcgtacggtaacgggaccctacgggtaccctaccgtaccctaaccggaaaccggaaaccggaaccccgaaaccccggtaaaacccgaaaaacccggtccggggttaaccgtaacccctaaacgtaaccgtaaccgtaaacccaaaccgtacgtaaccccgggaaacccctaggtaccggaaaccaacccggtaccgaaaccctaactaaccgttaacttaccggtgtaaccgtaccgtaacgggaacggggtaggttacggacgggttggggtacgggtaccgggtaccggtaccgggtaccggggaaccggtacgggtaccggttcggtaccggtaccgtacccgttcccgtaccctaccggtacccgtaccccgtaacccggaccggtaacccgggtacccgttaccggttacccccggtttccccggtccccccggtcggtacccccgttccccggtaccgtcccggttaaccggacccgggtaaccccgacccccggtaaaccggtacccggaacggtacccgaacccgggtacccgggtaccccgggg

SEQ ID NO: 71967 - DNA, 664 bp, Homo sapiens
  misc_feature: GYAE6OF01AS4NU.21.26.C04.1.454.CMB.1.raw
  modified_base (368)..(368): a, c, t, g, unknown or other
  misc_feature (368)..(368): n is a, c, g, or t
  modified_base (649)..(649): a, c, t, g, unknown or other
  misc_feature (649)..(649): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgctaggtggggtttgggctggactccgtcaccggacccccggaacggcccggagtggcttgcactctatttatggaatgatagactaaccactacacgcccatctcgtgacggaccaggcctccaccctcaacggaacggaccaccgtaacccaaaaccgngggtacggtaccctaaacgactacgacaacgacgtacgacccagtcggacacacgccacactactactgtcgacacggacgggagtcggcggttggggtcggtagggacctcgggtcggggaccgaggggaccgttccgtaggtccgcccggttctccgtaccgacgtcccctacggaacccggaacggtcccctacggtccgttccccgtccccgtacgggccccgtcccgtcgaccctcccggaaccggccgccctacccgggtcgacgaccggtaccnccggccggccccggg

SEQ ID NO: 71968 - DNA, 602 bp, Homo sapiens
  misc_feature: GYAE6OF01EDUSR.21.26.C04.1.454.CMB.1.raw
  modified_base (347)..(347): a, c, t, g, unknown or other
  misc_feature (347)..(347): n is a, c, g, or t
  modified_base (486)..(486): a, c, t, g, unknown or other
  misc_feature (486)..(486): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataacactacagccatctctgaggaccaggcctcaccctcacgaacgacaccgccaaaaaccngtacggtccaacactcgaccaacactcggaccccagtaggacacacgccaacatactactcgtgacacaacggggagtggacgtgggtgtcgggactacgtggggacccgtagggaggtccctggtccaccgtcctccncgacgtccctcctacccgaacggcccaacgtccggttccgttaccccccgtggcccgtcccctggtccctcccgaggacgcccgtacccgtacccgacggacgtccgacgaccggg

SEQ ID NO: 71969 - DNA, 836 bp, Homo sapiens
  misc_feature: GYAE6OF01D7NQW.21.26.C04.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccacagacgaccctcacgctgacctgcctaccttcttcgttgggttttcactcagtaccactgcgnggtgggtggtgggctggactccgtaccgaccggaccccccgggaaacggccccgggagtcggccgttcgcctacgttactatttagtaggtaatagtactacgtaactaacctactaacgactacctactacgtacgtacggacggaccgacgtacctacccgacccgtacgaaccggaacgacccgaaacccgaaaccgaaaaccggtacggttaccgtaacctaaccgaaccgtaccgaaacctacgacgtaccgaacccgagtacgaacaccgacgacctaactactactacgtacgtacgacgacggtacgggtacggtacggtacgggtacgggtacgggtacgggtaacggtacgggtaccggggtacgggtacgggttaccggttaccggttacggttacccgttacccggttccgttacccgtaccgtacccgtaccccgtacccggtaacccggtaacccggtaccccggttacccggttccccggttcccccgttcccccggtcccggtccccggttacccggtaccggtacccggtacccggtaccggtacccggtaccccgtaacccggtacccggaaccggaccggtacccgcccgggtaccgg

SEQ ID NO: 71970 - DNA, 909 bp, Homo sapiens
  misc_feature: GYAE6OF01A9M99.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctcggtgaaacccacagagaccctcacgctgacctgcaccttctcgttgggttttccactcagtaccactgcaggtgggtgtgggctaggactccgtcgaccggaccccccggaaaggccccgaggtcggtcttgcactctattatggaatgatgactaaccactacacgcccatcctcgtaggacggacctaggccttaccgacccctacgaaccggtaacgaaccccgacccgaaacccgtaaaaaccggtcgggttaccggtaacccctaaacgaaccttacggaaaccctaaacgacgtacccggaacccctagtacggaaccaccgacggaccctaaacgtaacttacccgttacgtggtacccgaccgaacgggtaacccggggtagggttacgggtaccgggttagggggtaaccgggttaaccgggggttaacccgttaacccgggggtttacggggggaaccccggtttaacggggggtaaccggtttccccgggttaacgggttacccccgtaaccccggtttcccgttaccccgttaccgccccgggttacccccttaacccgggaaaccccgggtaacccgggtaccccgttaaccgggtttccccggttacccccgttttcccccccgggtagggtccccccggtaccccgttacggtacccccggttccccgggaaacccggggtacccgaaccccttacccggggtaaccccgtaaccggggtccccacccggttaaccccggaccccggggg

SEQ ID NO: 71971 - DNA, 859 bp, Homo sapiens
  misc_feature: GYAE6OF01DTSCD.21.26.C04.1.454.CMB.1.raw
  modified_base (240)..(240): a, c, t, g, unknown or other
  misc_feature (240)..(240): n is a, c, g, or t
  modified_base (283)..(283): a, c, t, g, unknown or other
  misc_feature (283)..(283): n is a, c, g, or t
  modified_base (355)..(355): a, c, t, g, unknown or other
  misc_feature (355)..(355): n is a, c, g, or t
tcagtcgtcgctcgcacgaccggtgctcgatttagtctagcgactttgggttgggggaagaggaagactgacggtcctgctgctgaccatcccttcatgggtcttgtcccagatcaccttgaaggagtctcggtcccacgcgtggtacgaaacccagagacgaccctcacgctcgacctgcctacctttcttcgttggttttaccactcgaacgtaccacgtgcgtaggtgggtggcggngtcggactccgtaccgacccggacccccggaaacggccccggnggtacgtcgttacgacctaccttactagttttagtaggtaagttgaactcggtaaacctaacctactaaccncgacctatccgtcgaggaccgacgtcgtcctacctaccgacgaaccggaaccgacccaacccgaaaaccgaaaccggtcggtaccgtaactaaccgacgtaaccgaaaccgaaccacgtacccgaaccctaagtaccggaacctaaccgacgtaaccactaaacgttaccgttacggaccggtacgaaccggtaaccgggtaggggtacgttcccggtagggttaccggggtaggtaaccccggacggttaaccggggcgggtaacccggtagggtaacccgttccggtaaccggtaccgttacccccgttgtaacccctcggtaccccgtaccctaacccgggaaccggaacccggttcccccttaacgggttccccccgttcccccgggtaccccgtccggggtccccctttacccggtacgtcccggtaacccggacccggaccccgttaacccgacccgggttagacccggtaaccgtaacccgcgggtaacccccgggg

SEQ ID NO: 71972 - DNA, 852 bp, Homo sapiens
  misc_feature: GYAE6OF01AZN7G.21.26.C04.1.454.CMB.1.raw
  modified_base (236)..(236): a, c, t, g, unknown or other
  misc_feature (236)..(236): n is a, c, g, or t
  modified_base (758)..(758): a, c, t, g, unknown or other
  misc_feature (758)..(758): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctcggtcccacgctggtacgaaacccacagacgacccctcacgctcgacctgcctaccttcttcgttggttttaccacgttcacgtaccacgtgacagggtgggnggtcgggctggactccgtccgaacccggcccccgggaaacggccccggagtcggcttcgctacgtcgttatttaggtgtaagtagtagtacgaacctaacctactaccgacgtaccctacttcgttacgtacggaacggacccgtacggtcccctaccgtaaccccacggtaaccggaacggaccccgaacccgaaaaccccggtaaaaccggtaccgggttaacgttaccccaaaccggtaacgtaacccgaaaccgtaaacccgtacggtaacccggaacccgtaaacgtaccggaacaaacccgggacctaccaaaccgtaactaacgtacgttacgacgtacccggaacggtaacgggcgggttacggcggttagggtacgggtaacggacgtcgggtacgggaccggtaggaccgtttcggcgtacccgtccgtaccgtccgtacacccgcccggtaaccaacgggtacccgtaccgtaaccggttcccgttaccccgtccccggccggggttcccncccgggttacgcccgttaaacccgggcgggtaaccccgacccggttacccggacccggaaacggtcccggaaacccggtccggtaccccggggg

SEQ ID NO: 71973 - DNA, 696 bp, Homo sapiens
  misc_feature: GYAE6OF01AGKBF.21.26.C04.1.454.CMB.1.raw
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (391)..(391): a, c, t, g, unknown or other
  misc_feature (391)..(391): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctcgacctgctaccttctcgttgggttttcactcagtaccactgcgaggtggggtggtgggcgtggactccgtcgaccggacccccggaaggcccggtagtcggtcttgctactactagtttagtaggatgatagaactaaccnctacncnccatctcgtggacgacgcgcctaccacctacgaacgacggaccaccgaaccaaacggcggtacgtacaacnctacgacacacgtcgaccctaggtcgacacacacctacactactacgtcgacgacgaacggacgggtgtcggtcggtggggttacgtacgggtacgtacgggtcggggacgtacgggtacgttccgtacggtcccgtaccggtccgtaccgtaccgaccgtaccccgtacccgaccggtaacccggtcccgtaccgttcccgggttccccgttcccggccggtcccggtccccgtcggtacccggtaccgggaccggccgacccgtaacccggccgggaacgacccggcggacccggtcccgggg

SEQ ID NO: 71974 - DNA, 847 bp, Homo sapiens
  misc_feature: GYAE6OF01BMQ8V.21.26.C04.1.454.CMB.1.raw
  modified_base (128)..(128): a, c, t, g, unknown or other
  misc_feature (128)..(128): n is a, c, g, or t
  modified_base (215)..(215): a, c, t, g, unknown or other
  misc_feature (215)..(215): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggngtctcggtcccacgctgggtacgaaacccacacgacgaccctcaccgctcgacctgctaccttctcgttggtttcactcacgtaccnctgcaggtgggtggtggcgtggactccggtacgaccggacccccgggaaacggccccggtaggtcggtcgttcgacctactacttagtttacgttaggtaaatgacgtacgtaactaacccacgtaaccacgtaccctattctacgtacggacggtaacctacggcctaccgaccctacgaaccgtaaacggaaccaacccgaaacctaaaaccggtggtaccggaaccttaacgaacgtacgaaaccgaaacacgtaccgaacccaaggtcgaaccgacaccgaccaagtactaccttacgtacggtacgacggaacggtagggtacgtggtacggtggggttacggaacggtaccggtacggggtcgggaccggtacggggtaccggtacgtccgggtaccttcccggtacccgtacccggtaccgtaacccgtaccccgtacccggaacccggtaccgggtaccccgttaacccgggttcccccggtttacccgttaccccccggggaccggttcccccgggtacccttacccggggccccggtacctaaaccccgggggtacccgacccccggtacccggtaaaccccggggttaggaccccgtaacccgggccccggttacccgggg

SEQ ID NO: 71975 - DNA, 809 bp, Homo sapiens
  misc_feature: GYAE6OF01C9LOX.21.26.C04.1.454.CMB.1.raw
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtccccacgctggtacgaaaccccacgagacgacccctccacgccttcgacctcgcctaccctttctcgttgggttttcacctcgacgttaccacgtgctaggtggggtgtgggcgtggactccgtccgaaccggacccccgggaacggccccggaggtcggccttcgcctacttcgtagtttagttaggaagtgagtacgtaactaaccactaacncgacctatcctacgtggaccggtaacnccggcctacccgaccctaccgaacggaaccgaacccgtaacccggaaacccaaaaacccggtcggttaccgtaacccgtaaccacgtaccgaaccgaactacgtacccggaccctaagtacgaacctacaccgtaaccaccttaactaccgttacgtacgttccgaaccgtacgaacgggtacgggtcggttacggttgggttacgggtacgggtaccggttcggtaacggggccgacgggtaccgttcgtccggtaccgtacccgtccttccgtaccgtacccggtccgtaccccgaaccgggtacccggtcccgtaccgttcccggttccccgtccccggtaccgcccccgtcggtcccgaccccgttacggtaccggggaccctacccccgtaccggtaacccgagggacccctcgaacccgtccccggg

SEQ ID NO: 71976 - DNA, 797 bp, Homo sapiens
  misc_feature: GYAE6OF01D5IVZ.21.26.C04.1.454.CMB.1.raw
  modified_base (96)..(96): a, c, t, g, unknown or other
  misc_feature (96)..(96): n is a, c, g, or t
  modified_base (164)..(164): a, c, t, g, unknown or other
  misc_feature (164)..(164): n is a, c, g, or t
  modified_base (620)..(620): a, c, t, g, unknown or other
  misc_feature (620)..(620): n is a, c, g, or t
tcagtcgtcgctcgcacgaccggtgctcgatttagtctagcgactttgggtttggggggaagaggaagactgacggtcctgctgctgacatccctnatggtcttgtcccagatcaccttgaaggcgtctcggtcccacgctggtcgaaacccacagacaccctnacgctgacctgcaccttctcgtggttttacactcgacgtaccaactgacctgtagggtcgtggtactggtactacgtcaacccggaccccgaaaggcccggtacgtggccttggacctactacgttagtttattaggaataggtactagataaccaaccgtacgactaccccgtataccgtacggtaggaacggtaaccgtacgggtaccctacgtaacccccgttacgaacggtaaaccggtaacccgaacccgtaaaccgaaaaaaacccggttgggacccgggtttacaaaccgaaccgtcgtaaacccaacgtacgtacggacccctagactacgacgagaccctaagactactacggtgacgtcaacgagtaggtacgtaggtacggtgggtagtacctgggtacgtacccgaggtaccggtacgtacggaacgtacccggtcccttaccncgtaacccgaccgtacccgaaaccgaacccggtaccgtaccggttaacggtttcccccggtaccccgttaccgggtaacccgtcccggtcccgttacggaacccggtaacgggtaaaccgccccgtttaaccgggaccccgttaaaccgggcgttaacccgtaacgtacccccgggg

SEQ ID NO: 71977 - DNA, 995 bp, Homo sapiens
  misc_feature: GYAE6OF01EFORP.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatctaccttgaaggagtctggtcccacgcgtggtacgaaacccacacgacgacccctcgacgtctacgacctgacctacctttcttcgttcgggttttaccaccttactaacgtacccaacgtcgtacgtagggttgggtggtcgggtcgttaggtacgtcccgtaccggaccggacccccccgggtaaacgggcccgggacgtggtccttggacctacttacgttagttttaacgtggtaagtacgtaagtacgtaacctaaaccctaacctaacgaccgtacccgtacttccgttaccgtacggaaccgggacccgtacggaccctacccaccccggtaaccgaaccgggaaacggaaccccgaaaaccccggaaaaccgtaaaacccggtacgggttaaccggttaaaccctaaacctaccgtaaccgaaacccgaaccggtaacggaacccggtaaccccgtacggaccggtaaccgaaccgaaccgtaccctaaaccttaactaacccgtaccttcggtaccgaaccgtaaccgggtacggggtacggttcgggtccgggttaacggggtaacggggttcccgggtaaccgggttaaccggggtaccgggtacccgggttacgggccgtttacccggttaccgggttaccccgtaaccgtttcccccggtacctaaccccggtacccgtacccccgtaaccggtaaacccggaacccgggttacccttccccggggttacccggtttcccccggtaccccggttcccgggtaacccccggtccctaccggttacccgggtcccgaacccgggtacccgacccggtacccccggtaccgtaaaccggcccgtaaaccgggtcccggtaacccccgggg

SEQ ID NO: 71978 - DNA, 665 bp, Homo sapiens
  misc_feature: GYAE6OF01ELDG5.21.26.C04.1.454.CMB.1.raw
  modified_base (651)..(651): a, c, t, g, unknown or other
  misc_feature (651)..(651): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgcccccggaaaggccccggagtggcttgcactctatttagtggaatgatagaactaaccactaacagcccatcctctgacggaccaggcctaccaccctacgacgaacgacctaaccgaaccaaaaaccgtggtacggtaccctaaacacgtacgaaacctaacacgtacggaccccaagtacgacacgacgaccacgtatacgtaactgtacgaccgacgacgggagtggcgtagggtggtacggactacgggtcgggaccgagggtacgtccgtagggtcctaccggtcctaccgtaccgacgtacccgtaccgaaccggaacggccctaagtcccggttacccgttccccgaggccccgtacccgttgcccgttacccgaagggaccacccgtacccgtaccgaaggtaccncgaccggtaccggg

SEQ ID NO: 71979 - DNA, 829 bp, Homo sapiens
  misc_feature: GYAE6OF01C1TBD.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccacagacgaccctcacgctgacctgcctacctttctcgttggttttcactcagtaccactgcaggtgggtgtggctggactccgtcgaccgacccccggaacggcccggagtcggtcttcgactactctaattttagtagtaagtgatagaactaaccactacgacgaccattcgtacgtaggaccgaccgacggtcctacccaacccgtaccgaacggaacgtaaccaacccgaaaaccccgtaaaaaccgtacgggtacgttaacccaaccgtacgtaaccgaaacctaacacgtaccgaacccagtacgaccacgacgaccaacacttaccttacgtggtaccgaccgaacgggtacgggtggtacggccggttaggggtacggtacggggttaaccgtacggggacgggggtaacccgagggttacccggttaccggttaccgggtacccgttaccccggttccgtacccctaccgaccgttacccccgttaacccgaacccgggtaacccgggtccccgttaacccgggtttacccccggtttccccggttaccccccgggttccgggccccttacccccgggttcgttaccccggtaccccggaccgggtacccaccccgggttaccccggaacggacccggaactccccgggaaccggtacccccgggg

SEQ ID NO: 71980 - DNA, 760 bp, Homo sapiens
  misc_feature: GYAE6OF01DS6SZ.21.26.C04.1.454.CMB.1.raw
  modified_base (322)..(322): a, c, t, g, unknown or other
  misc_feature (322)..(322): n is a, c, g, or t
  modified_base (715)..(715): a, c, t, g, unknown or other
  misc_feature (715)..(715): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctgggtacgaaacccacagacgaccctcacgctgacctcgcaccttctcgttgggttttcactcagtaccactgcgaggtgggtggtgggctggactccgtcgaccggacccccgggaacggccccggtagtcggtcttcgcactctatttacgtggtaatgatacgactaaccactacncgaccactctcgtggacggaccgaggtccaccgaccctacgaaccgtaacggaccctaacccgaaacccgtaaaaccggcggttaccggtaacctaaccgaactacggaacccaaacgtacgtaccgaacccagtacggaactacgaaccgaccaaccgtaactactacgtcgtcgacgtaccggagggtacggtcgggtcgtggggtacggtacgggtacctacgggtccggggccgtaagggtccggttacgtcgggtaccttacccggtccgtaccgtaccgtaccgtccctaccgggtaaccaaccgggtcccgttaacggtccccgggttaccccttcccccggtagggtccccctcccggtacggtcccgtaccgaccggggtcccnccgtaccccggttaccgaaggtcccgcggtaccgtaccccggggg

SEQ ID NO: 71981 - DNA, 801 bp, Homo sapiens
  misc_feature: GYAE6OF01EDRIY.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctcgacctgctaccttctcgttgggttttcactcagtaccactgctaggtggggtggtgggcgtggtacgtcccgtccgaccggacccccccggaaacgggccccggagtcggtcttgaccacgttactaacgttttagttaggaaagttgtaagttacgtaacctaaacccaaccgttaacaaccggtcccctattccgtcgttaggaacggacccgtacggtcctaccaacccctaccggaaccgaacgggaaccgaacccgaaaccgaaaaaaccggttacggtaaccggtaccctaacgtaaaccgtaccgaaacccaaacgtaccgtaccgggaacccctagtaccggaacaaccgacgaccaactaacctacttaacgtcgtacgtacgaacgtcggggtaacgttcgggtcgttacggggtgggacgggtacgtaccgggtcgggaacggcgggtaccgtcggtcgtccgtcccgtgttacccgacgcctaccgtaccacccgaacggcccgtacgtcccggttacccgttcccggtaccgtcccggcccgttcggtacctacccgggacggtacccgtaccgtaacccgtaccggaacggccgacccggtccggaaccccgggg

SEQ ID NO: 71982 - DNA, 848 bp, Homo sapiens
  misc_feature: GYAE6OF01AH18E.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcgtggttttcactcagtaccactgcaggtgggtggtgggctggactccgtcgaccgacccccggaaacggccccggagtcgctgccactctattatggaatgtatagtaactaaccactacaccgccctatctcgtacgacggaccgacgtcctaccgaccctaccgaacggaaacggtacccaaacccgaaaccccgtaaaaaccgtacgggttacgtaaccctaaacctaacgtaccgtaaacccaaacgtaaccgtacccggaaacccctaggtaacgaaccaaccgaaccgaccccaaacttaactaaccgttacgtacgtacccgacgtaaaccggtacgggggtaacgttcccggggtaggttacgggggtcgggtttaacgggggaacccgtttaccgggggtccgggggtaacccggtacgggggttaccggttcccgggtacggttaccccggtacccgttcccgttaccccggtaccgacccgtaccccggttaaccccgaaccgggtaaccccgtacccggtccgtttccccgggttcccccttccccgggtccggtacccggtccccgtccggtaccccgtacccgggtaacggtcccgaaccccgtaacccggtcccgtaaacggcctaaacccggtccggtaccccgggg

SEQ ID NO: 71983 - DNA, 872 bp, Homo sapiens
  misc_feature: GYAE6OF01BI2LJ.21.26.C04.1.454.CMB.1.raw
  modified_base (128)..(128): a, c, t, g, unknown or other
  misc_feature (128)..(128): n is a, c, g, or t
  modified_base (805)..(805): a, c, t, g, unknown or other
  misc_feature (805)..(805): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcacttgaaggngtctggtcccacggctggtacgaaacccacaagacgaccctcaccgctcgacctgtcctaccttcttcgttgggttttcactctacgtaccacgtgcgtaggtgggtggtcggcgtggtacctccgtaccgaccggacccccgggaaacgggccccggtagtcggcgttcgacctacttacctagttttaagtaggtaactaggtataacgaacctaaccgaactaccgaccgacccttactccgtacgtaacggaaccgaccgtacgacccttacccgaacccgacgaaccgggaaacccgtaacccgaaaacccgaaaacccgtaaaacggtaccggttaacccgtaaaccgtaaccgtaaccgtaaccgtaaccaaaccggtacgaacccgtaccgaacgtaccgaaccgaactaaccgaactaaacctaactacccgtaagtacgaccgaaccgggaacgggaacgggtcggtcggtacgggtacgggttacgggtacgggttaacccgtcgggggaaccgggtcggtaaccgggtccggtttacccggttaaccggtcccgttaaccccgttccctaaccggaccgttacccggaaccccttaccgggaccccggaaccggttccgttaaccgtccccgtcccgttcccggaccggtcccctcggttaaccnccggtaaccggcccggtaacggacccctacgggacccgacgggtaccgcccgtaaaccgggcccggg

SEQ ID NO: 71984 - DNA, 928 bp, Homo sapiens
  misc_feature: GYAE6OF01BL23L.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctgggtcgaaacccacagacgaccctcacgctgacctgctaccttcttcgttgggttttcactcacgtaccactgcgaggtggggtggtcgggtcgtacggtacgttcccgtccgaccggaccccccgggaaaacgggccccgggtaggtcggtcgtttcgacctacctacttaagttttacttaggaaacttgtacgttacgtaactaacccgtaaccttaacgacgtacccctaaccgttccgttacgtacggtaaccgggtacccgtaaccggtcccttacccgtaaccctaccgaaaccgggaaacggaaccccgaacccgtaaacccgaaaaaccggtacgggttacggtaaccctaaccgtacgtaaccgaaaccgaaacgtaccgtaccgaacccgtaggtacggaaccacgacgacctaaactacttaaccgttacgttacgacctacggaaccgggtacggggtacgttacgggtacgggttcgggttaacgggtacgggtaaccgggtttacccggggacggggtccggtaaacgggggtccgttaccccggttacgggttaccccgtcccggttcccttacccggtaccgaccccgggtaccccggtaccccgtaaaccgggaccggggttacccccttagggttcccccgggtttcccgttaaccccccgggttcggacccccggtcccggttacccggtcccgttacccggggaaccgacccggttaaccccgtcccggaacggaccgttaccggaccgacccgggtcccggg

SEQ ID NO: 71985 - DNA, 831 bp, Homo sapiens
  misc_feature: GYAE6OF01AVHY3.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcctacctttctcttgggtttcactcacgtaccactgcgtaggtgggtggtgggcgtggactcccgtaccgaccggaccccccgggaacgggcccggaggtcggtcgttgctacgtcttagtttacttaggaagtaggtactagaactaaccgactaccacgaccctactccgttcggtaggaccggtaccgacgtacctaccctacccgtaccgaacggaaccgaccctaacccgaaacccgaaaccgtacgggtacgtaccctaacgaaccgtaacaccgaactaaccgaccggaccctacgtaacgaccgaaccgacgtaccaaccgtaacttaaccgtacgttcgacgtaccggaaccgggtacgggtaggttgggaccgggttgggtacgggtacggtaccgggacgggttacgggacggtacgggtaccggtaccggttacggtccccgtaacccgtccgttaccgtcgtacccggtacccgtacccgtaaccgggaacccgggtaccctaaccggttccccggttccccgttaccccgggcccggtaacccggttcccgtccccgggtaacccgttacccggaccgtacccggtaacccgtccccggaaccgggtaaccgaccggttaacggaccccggtacccgggg

SEQ ID NO: 71986 - DNA, 821 bp, Homo sapiens
  misc_feature: GYAE6OF01AO98L.21.26.C04.1.454.CMB.1.raw
  modified_base (467)..(467): a, c, t, g, unknown or other
  misc_feature (467)..(467): n is a, c, g, or t
tcagtcgtcgctcgcacgaccggtgctcgatttagtctagcgactttgggtttgggggaagaggaagactgacggtcctgctgctgaccatcccttcatgggtcttgtcccagatccaccttgaaggagtcctggtcccacgctggtacgaaacccacagtacgacccgtcacgctcgacctgcctaccttctcgttcggtttcaccgtcacgttaccactgacgtaggtgggtggtcgggtctggactccgtcgaccggacccccggaaaggccccggtaggtcgacttcgctactctagttataggatagataggaactaaccgactacgacgcctaatcctacgtcgacgtaccgacgtccctaccaacccgtaccgacggtaacgaccgtaacccgaaccgtaaaacctggggtacctaacctaacgtaaccgtacaaccgtaacgtacgtaccggtaacccnggaccggtaccaacgacctaccgaactacgtacctacgcggtacctacgaccggtaggtacgtggtacgggttacggttaggaccggttaccgtacgggccgggtacggtaaaccggttccgtaccggttaccggtacccgtaacccgtttcccgttaacccggtaccggtacccttacccccggttaaacccaacccggggtacccgtaccccggttaccggtacccccgggtttcccgtaccccggaacgggttcccccgggtcttaccccgttaccggaccggtaccgacccgttaccccgtaaccggacccgggaccgttaaacccgccccgggttaggtaccccccggg

SEQ ID NO: 71987 - DNA, 770 bp, Homo sapiens
  misc_feature: GYAE6OF01D8DV1.21.26.C04.1.454.CMB.1.raw
  modified_base (157)..(157): a, c, t, g, unknown or other
  misc_feature (157)..(157): n is a, c, g, or t
  modified_base (553)..(553): a, c, t, g, unknown or other
  misc_feature (553)..(553): n is a, c, g, or t
  modified_base (714)..(714): a, c, t, g, unknown or other
  misc_feature (714)..(714): n is a, c, g, or t
  modified_base (732)..(732): a, c, t, g, unknown or other
  misc_feature (732)..(732): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtacgaaacccanagacgaccctcacgctgacctgctaccttctcgttgggttttacactcacgtaccactgcgtaggttggggttcggctagggaccttccgtccgaacccgggaccccccgggaaacgggccccggtaggtcggtccgttcgacctacttactaagttttagtaggaaatgtagtacgtaacttaaaccactaccacgaccctattctagtacggaaggaccgacggtccttaaccccacccgtaccggaacgaaccggaacccgtaacccgaaaccgaaaaccggtcggtaccgtaacctaaccgtaccgacgaacccaacgtacgcccggaaacctagacggaacctacgaaccgtacccaactactaccgttacgtcgtaacgaccgaacgggngggtacgggtcggttacgggtggggtacgtacgggaccgtttacggggcggacgggtaggtaccgttccggtcgtaacccgtccgtacttcccaacgccctcccgaaccggaccggtaccgtcccacggttccccgttacccgtcccgacgccctcccgtnacccggtacggacgcccncgaacccgtgaaccggcaaccggtccggccgtcccggg

SEQ ID NO: 71988 - DNA, 856 bp, Homo sapiens
  misc_feature: GYAE6OF01ER2QM.21.26.C04.1.454.CMB.1.raw
  modified_base (626)..(626): a, c, t, g, unknown or other
  misc_feature (626)..(626): n is a, c, g, or t
tcagtcgtcgctcgcacgaccggtgctcgatttagtctagcgactttgggtttgggggaagaggaagactgacggtcctgctgctgaccatcccgttcatgggtcttgtcccagatcaccttgaaggagtctcggtcccacgctggtcgaaacccacagacgacccctcacgcctagaccttgctacctttcgtcgtttagggtttcaccgtctacgtacccactgactaggtcgggtggtcggcgtaggacttcccggtaccgacccggaccccccgggtaaacggcccccggtaggttcggtcttacgcctacgttacttagttttagtaggtaacgtcgtaacgtacgtaactaacctactaacgacgaccctacttcgtaccgtagacggaccgtacgtccaccctacccgtaccgaaccgaaccggaccgaaaccccggtaacccgaaaaacccgtcggttaacccggtaacccgttaaccgaacccgtaacgaacccgtaaaccgtaccggtaacccggaccccgtaacgtacgaaccaaccgactaccctaactaaccgttaacgtaccgtacgtaccgaccggtaacggtaccgggtacggtacggtacggttcgggngttacccgggtaccgtaccgggtagggtaccgacggggttaccgtacccggtaccggttaccgtacccggttacctacccgtaccgtacccgtacccgtaccgtaaacccggaccggttaccccgtaccgttccccgtaccccgttaccccgtcggcccgtttcccgacggtacccgccggtaccgaccgtacccgtaccgtaccggaacgacgtcccgacggtacccgg

SEQ ID NO: 71989 - DNA, 854 bp, Homo sapiens
  misc_feature: GYAE6OF01DLA97.21.26.C04.1.454.CMB.1.raw
  modified_base (156)..(156): a, c, t, g, unknown or other
  misc_feature (156)..(156): n is a, c, g, or t
  modified_base (841)..(841): a, c, t, g, unknown or other
  misc_feature (841)..(841): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccagctggtacgaaacccanagacgaccctcacgctgacctgcaccttctcgttcggttttcactcgtagtaccacgtgcgtaggtggggtggtcgggtactcggacctccggtccgaaccccggaccccccgggaaacgggcccggaggtcgtcttcgactacttctaagttttacgtgaagtcgtaatacgaacctaaccgacctacgaccgtaccctatcctacggtaggaaaccggaccgacggtcctcccgtaacccgtaacggaacggtaaccggaacctaaccccgaaaacccggtaaaaaccgtccgggtaaccggttacccaaacgtacccgtacgaaacccgtaaacgtccgtaacccggaacccgtacgtaacggtaaccgaccgacgtacccaaacttaaccgttaaccgtaccgttacgttaccgaccccggtaaaggggtaccggggtaacggttcgggtcgggtttacgggggtaccggtaacggggttacccggtaacggggtccggggtaacccgggtacgggtccgttaccggtacggttaccgtacccgttcccgtacccgtacccgacccggtacccgtaccgaaccggtacccggtctaacccgttcccggttcccgtcccggtcgccccggtaccgtctacccggtcgaaccggtccgaccgtacccgtacgaccgggtaacnccgtcggcccggg

SEQ ID NO: 71990 - DNA, 662 bp, Homo sapiens
  misc_feature: GYAE6OF01ETWG6.21.26.C04.1.454.CMB.1.raw
  modified_base (406)..(406): a, c, t, g, unknown or other
  misc_feature (406)..(406): n is a, c, g, or t
  modified_base (465)..(465): a, c, t, g, unknown or other
  misc_feature (465)..(465): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcacgacccccggaaaggccccggagtggcttcgctactctatttattaggaatgatagtaataaccactacagcccatctactgaacggaccaggcctaccaccctacgaacggaacggaccaacccgaaccaaaaaccgaggtacggtaccctaaacacctacgaaccaaanacgtacgaaccccagtacggaacacgagaccacactaactactgtacgacacgacgggngtagggtcgtggggtagtacgggacgttacggtacggggaccgaggggacgtcgtcggtccaccggttcctaccgtcgacgtccctacccaaccggaaccggcccacgttccggttccccgttccccgtacggccccgtccctggccctaccggacggaccacccgtaccgtaccggagacggccaacggacccggg

SEQ ID NO: 71991 - DNA, 890 bp, Homo sapiens
  misc_feature: GYAE6OF01BF6UP.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagactctaccttgaaggtatcgtcggcccacgcgtggtacgaaacccacgagacgaccctcgaccgtctacgacctcgcctacctttctcgttggtttaccactcgacgtacctacgtgcgtaggtgggtggtcggtcgtaggaccttccgtaccgaacccggacccccccgggtaaacgggccccggtaaggtcggtcttacggacctacttacttagttttacgtaggtaattagtagtacgtaacctaaaccacgtaccgacaccgtacttccgtcgagtaaccggacctacggtcctacccaaccgtccgaaacgggaaccggtaccgaacccgtaaaccgtaaaaccggtcgggtaaccgttaacccaaaccgtacgttaaccaaacccgtaacgtacccgttaaccggaccccgtaaggttaacccggaaccaaccgtaaccgaacccaacggtttaaaccttaccggtaaccggttacgtacgtaacccgaacgggtaaccggggttacgtacgggtaccgggtttaggggtacgggttacggggtaacccgttacggggtacggggtaacccggtaacgggttccgggtttacggtcccgggtttaccgacccggtttcccgtaccctaccggcccgttaccctacccggaacccggtaccgggttaccctaccggttcccggttaccccggtcccgtccggtacccggtcgtacccgtccgtaccggacgtcccaccggtaccgtacgcgaccctaggcccggtaccggg

SEQ ID NO: 71992 - DNA, 781 bp, Homo sapiens
  misc_feature: GYAE6OF01DFUS0.21.26.C04.1.454.CMB.1.raw
  modified_base (360)..(360): a, c, t, g, unknown or other
  misc_feature (360)..(360): n is a, c, g, or t
  modified_base (759)..(759): a, c, t, g, unknown or other
  misc_feature (759)..(759): n is a, c, g, or t
  modified_base (772)..(772): a, c, t, g, unknown or other
  misc_feature (772)..(772): n is a, c, g, or t
tcagtcgtcgctcgcacgaccggtgctcgatttagtctagcgactttgggtttgggggaagaggaagactgacggtcctgctgctgaccatcccttcatggtcttgtcccagatcaccttgaaggagtctcggtcccacgctggtacgaacccacagacgaccctcacgctacgacctcgcctacctttctcgtttacgggtttcactacacgttaaccacgtgccgtaggtggggtggtcgggtcgtacggaccgttcccgaccgaaccccgggaccccccgggaaacgggtccccggaggtcggtcgttcgacctacgtactatttacgtagatagactacgtaactaaccaccgtanaccgtacctctaccgtcgtacggaccgaccgtacggtacctaccctaccccgtacgaaccggtaacggaaacccaaacccgaaacccgtaaaaccgtaccgggttaaccgtaaccctaaccgtaccggtaacccaaaaccgtaaacctacggaaccccgtaaacccgtaggaaccggaaccaccgtaaaccgaccctaataacccgttaacgtacgtcgtaccaaccgtaacgggtaccgggaggttccgtacggggttaggtacgggtacggtaccgtacggggtccgggtaccgtagggtaccgtccgtacggtaccctcggtcccttacgacgtccctccgaaccggtaccacggccttccgtcctcctccgccgcctacgcctcgcgacgtaccncgaccgagcaacncgtcgccgg

SEQ ID NO: 71993 - DNA, 806 bp, Homo sapiens
  misc_feature: GYAE6OF01BJEAI.21.26.C04.1.454.CMB.1.raw
  modified_base (558)..(558): a, c, t, g, unknown or other
  misc_feature (558)..(558): n is a, c, g, or t
  modified_base (734)..(734): a, c, t, g, unknown or other
  misc_feature (734)..(734): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagacgaccctcacgctcgacctcgcctacctttcttcgttgggtttttaccacctacacgttaccactgccgtaggttggggtggtcgggcgtggtactcccgtccgaaccggaccccccgggaaaacgggccccggaggttcggcttacggacctaccgttaccttaagtttttagttaggaaagttggtaagttacgtaaactaacccctaacttaccaacggaccccctaatccgtttccgtagggaaccgggtacccacgggtacctaccccgtaaccccgtacgaaaccgggaaaccggtaccccaaacccgaaaccccgaaaacgtccgggtaacggtacccaaacaccgtaaccgaaacccgtaacacgtcccggaccccagtcgaacacgaacncccaactacgtacctaacgtcgtacggaccgacggacgggtcgtacggtcggtagggttcggtacgggacgttacggtcggggctagggtacgtccgttcggaccttccgccttacccgcctaacggccccctacgacccggaacggtcccgtacgttccggttcccttcccccgngtacccggtccctacgttcccgaccgacggtacctacccgtccccgtaagcccgacggcccgcgtacccggg

SEQ ID NO: 71994 - DNA, 795 bp, Homo sapiens
  misc_feature: GYAE6OF01CR204.21.26.C04.1.454.CMB.1.raw
  modified_base (742)..(742): a, c, t, g, unknown or other
  misc_feature (742)..(742): n is a, c, g, or t
tcagtcgtcgctcgcacgaccggtgctcgatttagtctagcgactttgggtttggggggaagaggaagactgacggtcctgctgctgaccatccttcatgggtcttgtcccagatcaccttgaaggagtctgggtcccacgctggtacgaaacccacagacgaccctcacgctcgacctgctaccttctcgttgggtttcactcacgtaccactgcaggtcgggtggtcggtcgtcggtacgttcccgacgacccggtaccccccgggaacggaccccggtggtcgtccgtcgacctactcttatttagttgggaattaggattaacggaacttaaccctacctacaccgacctatctacgtagaaccggtacctacggcctccctacccgacgaaccggaacgaccgtaaccccgaaacccgaaaaccggttacgggtacctaaccgaactaccgtacgaacccaacgacgtacccgaacctagacgaccacgaacgtaccacgtactaacgtcttaggaccgtaccgaacgggtacggggtaggtaccggtcgggttacgggggtacggttaccgggaccggtaaccggggtcgggaccggtaagggtcccgtcccggttaggtcccggtaccctccgttacccgaacggtccctacccgacccggttaacggaccccgtcgtacccggttcccgttcccccgtaacccgggtcggccccgtacccgtaccgggtccccncggtaccggcctacccgtacccggaacgtaggcccaccgttaaccgggcccgg

SEQ ID NO: 71995 - DNA, 760 bp, Homo sapiens
  misc_feature: GYAE6OF01CNKCN.21.26.C04.1.454.CMB.1.raw
  modified_base (129)..(129): a, c, t, g, unknown or other
  misc_feature (129)..(129): n is a, c, g, or t
  modified_base (158)..(158): a, c, t, g, unknown or other
  misc_feature (158)..(158): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (372)..(372): a, c, t, g, unknown or other
  misc_feature (372)..(372): n is a, c, g, or t
  modified_base (536)..(536): a, c, t, g, unknown or other
  misc_feature (536)..(536): n is a, c, g, or t
tcagtcgtcgctcgcacgaccggtgctcgatttagtctagcgactttgggtttgggggaagaggaagactgacggtcctgctgctgaccatcccttcatgggtcttgtcccagtatcaccttggaaggngtctcggtcccagctgggtacaaacccanacgacgacccctcacgctacgcctgcctaccttcttcgttggtttcacctcaagttccactggngtaggtgggtcggngggtcttcggacctccgtcgaccccgggaccccggtaacggtcccggaggttcggtccttcggacctacgttaccttaagtttacggttaggaacttcggtatactaaaaccttaccgaactacgaaccgtccctntccgtacgtaggaaaccgccgacggttacctaccctacccgtagaaaccggaaccgtaaccccgaaccgtaaaaccgaaacggtcgggtaccttacgaaaacctagacccgaaactaccaggttacccgacctaggcgaaccacgtacaccaaggtacacgttncgacgacacgggcacgggtgtcggtgggtagcgtacgtaggcggacgtagggtccttacggcgttaccgccgtccgtacgaccttacccgaccgtaccgtaccggaccgttacctccggtccccggttacctccccggttccggcccgttcggtaccgaccggtaccccgtaaggccccgtacccgttacgggccccaagggcccgtaccggaacggtccccgg

SEQ ID NO: 71996 - DNA, 810 bp, Homo sapiens
  misc_feature: GYAE6OF01D8TVW.21.26.C04.1.454.CMB.1.raw
tcagtcgtcgctcgcacgaccggtgctcgatttagtctagcgactttgggtttgggggaagaggaagactggacggtcctgctgctgaccatcccttcatgggtcttgtccagatcaccttgaaggagtctggtcccacgcgtggtacgaaacccacgagtacgaccctcacgtcgtcgtacctgactaccttcttcgttggttttcacttactagtacctacgtcgcgtaggtgggtcggtgggccgtggacgttccgtacgtacccggacccccgggaaacggaccccggtagtcggtacttacgacctacttacgttattttagtaggtaagtagtacgtacgtaacgtaaaccctactaaccgaccgacccgtaactccgttacgtacggtaccggtaacccgtacggtccctaccgtacccgtacgaaccggaacggaacccaaaccgtaaacccgaaaaccggtcggtacgtaccaaccgactacgaaccaagaccgtaccgtacccgtagacggaccaccgcaccactacgtacctacgtcacggaccgaacggtcgggtcgttacggtcgcgggttaggtaccggcgtacgggtaccggtacggtacgggtaccgttaccgtcggtacccgtacccgtccgtcccggtaccggtacccgtaccccgttaccgaacccggtaaccgggtccccgttaaccgttcccggttaccccgttccccgtcggaccccggtccgttaccgccgtacccgggacgtacccgaaccccgggtctaccgggactacctccgacggtccccgg

SEQ ID NO: 71997 - DNA, 762 bp, Homo sapiens
  misc_feature: GYAE6OF01B7A7S.21.26.C04.1.454.CMB.1.raw
  modified_base (98)..(98): a, c, t, g, unknown or other
  misc_feature (98)..(98): n is a, c, g, or t
  modified_base (163)..(163): a, c, t, g, unknown or other
  misc_feature (163)..(163): n is a, c, g, or t
  modified_base (235)..(235): a, c, t, g, unknown or other
  misc_feature (235)..(235): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (377)..(377): a, c, t, g, unknown or other
  misc_feature (377)..(377): n is a, c, g, or t
  modified_base (553)..(553): a, c, t, g, unknown or other
  misc_feature (553)..(553): n is a, c, g, or t
tcagtcgtcgctcgcacgaccggtgctcgatttagtctagcgactttgggtttgggggggaagaggaagactgacggtctgctgctgaccatcccttnatcgggtacttgccagactcaccttgaaggtagtcgtcggtcccacggcgtaggtacgaacccanacgacgaccctcaacgctagacctgacctaccgttctcgttcggtttaccaccgaacgtaaccacgtgacgnggtcgggtaggnggtacgnggtacgtccgaccgaaccgggacccccgggaaaggcccggtagtcggtacttacgacctacgtacgtattagtaacggtataggtaataccgtaaacttaaaccgacacggtaacctaacccnggttacgtacgttaacggaaggttaaccgaaccggtcccttaaccgaacccgtaacgaaacggaaaccgaacccaaaccgggaaaacaaaccgggttaacgtccggaaacctaacgacaacgtaacgaacgtcgaaccgtaccgagtagaacacgtacaactagttaacagtacgngtacgaacgacggacgtaggtggacggtaggtacggacggttagaccggtacgggacgtacggtccgttacggcgtaccgtacgtacgaccgtacgaccgaccgtaccgaaccgtcgtaaccgtccgtaccgtcccgtcccgtaccgtccgacgtccgactacggccacggtacgccgtaacggtaacgctaaccgcggcgtacccggg

SEQ ID NO: 71998 - DNA, 696 bp, Homo sapiens
  misc_feature: GYAE6OF01BQT5N.21.26.C04.1.454.CMB.1.raw
  modified_base (452)..(452): a, c, t, g, unknown or other
  misc_feature (452)..(452): n is a, c, g, or t
  modified_base (680)..(680): a, c, t, g, unknown or other
  misc_feature (680)..(680): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctcggtcccacgcctggtcgaaacccacagacgaccctcacgctgacctgcaccttctctgggttttcactcagtaccactgcagtgggtggtgggctggatccgtcgacggccccccggaaaggccccggagtcggctgccactctatttatggattgatgaactaaccactacgacgaccctatcctctagacggaccacggcctccaccctcacggaacggaccaccggtaaccaaaaaccgtggtacggtaccctaacactcgaaaccaacgcgtacggaccccagtacggacacacgaccactactactaactgtnaccacggacgggtacgtcgggagttggggtacgggtcgggtacgtacggtacgggggccgaaggggccttaccgttcgggtacccgtaccgtccgtcctccgaacgtcccctacccgtaccggaacccggtccctaaccggttcccggtacccgtttccccccgacgggtccccgtcccgtacggcccgttacccgacgggccaccccgtaccgtacccgaagggccnccgacgtcccccgggg

SEQ ID NO: 71999 - DNA, 903 bp, Homo sapiens
  misc_feature: GYAE6OF01AVV59.21.26.C04.1.454.CMB.1.raw
  modified_base (144)..(144): a, c, t, g, unknown or other
  misc_feature (144)..(144): n is a, c, g, or t
tcagtcgtcgctcgcacgaccggtgctcgatttagtctagcgactttgggtttggggggaaggaggaagactgacggtcctgctgctgaccatcccttcatgggtcttgtcccagatcaccttgaaggtagtctggtcccacgntggtacgaaaccacagacgaccctcacgctagtacctgctaccctttcttcggttcgggttttacctacctcgtacgtaacctacgtacgtcgaggttcggggttggtcggggtcttcgggtaccgttcccggtaccgaaccccggaaccccccgggggtaaacggcccccgggtaggtcggtcgttcgaccgtacctacgttaagttttacgttagtaagtgtacgtagaacttaaccctaactaccgtagcccctacgtcgttccgaggtaaccggaccgtacgggtcccttacaccccgtaccgtaaacgggaaccgtaaccggaacccgaaacccggtaaaaaccgttcggggttaccggttaacccctaaaaccgtaccgtaaaccgaaaccccgtaaaaggtacccggtaaaccggacccccgttaaaggaaccgaaccggtaacccaaccgtaaccctaacgttaccgttaaccttaccgggttacgtaacgggtaaccccgaaaccggggttaacgggtaacgggttaggttcccgggttaaggggttaccgggttacggtaaacggtcgggggtaaccgtaccggggtacgtcccggtttcgtacggtcccgtaaccgtccttaccgtacctaccgtccgtacccaacggttacgacccttcggtcccgtaccgttccccgtcgcccgtccgtacgtccggaccgtacgaacggccccgttaacggccagactccggcgtaaccccgggg

SEQ ID NO: 72000 - DNA, 800 bp, Homo sapiens
  misc_feature: GYAE6OF01ET2N2.21.26.C04.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (746)..(746): a, c, t, g, unknown or other
  misc_feature (746)..(746): n is a, c, g, or t
tcagtcgtcgctcgcacgaccggtgctcgatttagtctagcgactttgggtttggggggaagaggaagactgacggtcctgctgctgaccatcccttcatggtcttgtcccagatcaccttgaagagtctggtcccagctggtacgaaacccanagacgaccctcacgctcgacctcgctacctttctcgttggtttcacctnactaccacgtcgcgtaggtcgggtggtcggcgtcggtactcccgtacgacccggaccccccgggaaaggccccggtaggtcgtctcgactacgttactagtttagtagtactagtagtacgtaaccttaaccgaccgtaaccacgtcccaacgttccgtaccgtacggaccggtaccgacggtccctacccaccctacgaaccggaacgacccgaacccgaaccgaaaaccgtggtaccgtaaccacgacctacgaacctacgacgtacccgacctagtacgaccacgacgaccaatactactacgtagtcacgtacggtacgggtacgtcggtcggtcggtcgggtacggtaccgtacggtaccgggtacggacgggttcgtaccggttaccgtcccgtaccgtcccggtacctacccggacccgtacccgtaacccgtacccgggtaaacccgtcccgttaacccggttccccggttaacccccgttccccgggaccccggtccccgtttaccctcccgggtcccgtacggaccccggtanacccccggtaacgtccccggtaaaacgccgaaacccggtcccggaaccccgggg

SEQ ID NO: 72001 - DNA, 838 bp, Homo sapiens
  misc_feature: GYAE6OF01DZV2X.21.26.C04.1.454.CMB.1.raw
tcagtcgtcgctcgcacgaccggtgctcgatttagtctagcgactttggtttgggggaagaggaagactgacggtcctgctgctgaccatcccttcatgggtcttgtcccagagtcaccttggaaggtagtcgtcggtcccacgtctggtacgaaacccacgagaacgacccttcacgctacgacctgcctacctttctcgttcggttttacactcgtacgtaccactgactggtggtgtggctggtactccgtacgacccggacccccggaacggcccggtagtcggtcttcgacctacgttcttaagtttagtacggtaagtacgtactaccgtaacctaacctactaccgaccgtacctactccgtacgtacggtaccggtaccgtacgtcctaccgaccgacggaaccggaacgaacccgaaccggtaaaccgtaaccggtcgttaccgtaaccgtaacgtaccgtaccgaacctaacgtaccgtaccgtaaccgacgtaccgaccgtaccgacgtacctaacgtaacgttaccgtacgtcgtaccgaccgtaacggggtacggtcgggttacggtcgggttacgggtaccgggttaccggtaccgggttaacgggccgggtacggttaccgggttcccgttacgttacccggaccttaccggttcctaccggtcccgtaccggtaccccgtaacggtacccggtaccgttacccgttccggtacccccggttcccgtacccggtccgtcccgttaccgtaccggacccggttaacgacccggtacccacccgttaccgggtaacggaaccgtcccgaccggtccgggtaccgg

SEQ ID NO: 72002 - DNA, 819 bp, Homo sapiens
  misc_feature: GYAE6OF01CN5M5.21.26.C04.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcacttgaaggngtctggtcccacgctggtacgaaacccacagacgaccctcacgctcgacctcgcctacctttctcgttcggtttacactctacgtaccacgtgcgtaggtgggtcggtgggctggactccgtaccgacccggacccccggaacgggcccggtaggtcggtcttcgacctacgttacttaagtttagttaggtaagtgtaatacgtaactaaccgactaccgacgcctagtctcgtaggacgaccgtcgcctaccaccgtacgaacggaacgaacccgaacccggtaaaccgaaaaccggtacggttacccgtaacctaaaccgtaaccgtaaccgaaaccctaaacgaccggtaacccggaacccctacgtacggaaccctaacgacccgaaccctaacgtaaccttaacgtacgtacggtaccgtacggaacggtacgggtacggtcggtcgggtacggggtacggtacgggaaccggtcgggacggggtaccgtacgggtaccgtccggttacggtacccgtccgttaccctccggtacccgaccgtaccccgtaccggaacccggtacccggtacccgttcccgtcccggttaccccgtcccggtaccgccccgtccgtaccgtacccggacggtacccggaccgtacccgttacccggacgtaccggaccgccgtacgggtccccggg

SEQ ID NO: 72003 - DNA, 751 bp, Homo sapiens
  misc_feature: GYAE6OF01A6KSA.21.26.C04.1.454.CMB.1.raw
  modified_base (387)..(387): a, c, t, g, unknown or other
  misc_feature (387)..(387): n is a, c, g, or t
  modified_base (707)..(707): a, c, t, g, unknown or other
  misc_feature (707)..(707): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctcggtcccacgctggtgaaacccacagacgaccctcacgctgacctgcaccttctctggtttcactcagtaccactgctaggtgggtgtaggctggactccgtccacgaccccccggaaacggccccggagtcggacttgcactcgtatttagtaggaatgatacgactaaccacgtacaccgtccatactcgtacgtacgggaccacggtcctctacccgtacaacggaacgaccgaacccgaaccaaaaaccgnggtaccgtaccaactactaccgaaccacacgtacggaacccctagtacgacaaccgactaccgaacacgtacttacgtacgtacgaccgaaccgtacgggtacggtcggacggttacgggtaggtaccgggtaacgtaccgggcgggacccggtagggtaccggttcgttaccgggtaccgtacccggtaccgttcccggaccgacccgggtacccctaacccggtaccccggaaccgggtaccccttaaccgtcccggttaaccccgtccccggttaccgggcccgttcccgtacgtccccgttccgaaccgggtaccncccgttaccccgacggtaacccgcgacccgacccgtaacccggg

SEQ ID NO: 72004 - DNA, 824 bp, Homo sapiens
  misc_feature: GYAE6OF01DOYEC.21.26.C04.1.454.CMB.1.raw
  modified_base (193)..(193): a, c, t, g, unknown or other
  misc_feature (193)..(193): n is a, c, g, or t
  modified_base (565)..(565): a, c, t, g, unknown or other
  misc_feature (565)..(565): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggtagtctcggtcccacgtcgtaggtacgaaacccacagtacgaccctcgaccgtctacgacccgttcnccgtacctttcgttcgttcgggtttttaccactaccgtacgtaccctaccgtcggacgtgggtggggtggtcgggcgtcggacgtccgtaccgacccggaccccggtaaaccggccccggaggtcgtcgtcgacctacttacttagtttagttacggtagtaggtaatacgtaaaccgtaacctaaccgtaacacccgtaccctacttccgttacgtacggaaccggtaccgtaaccggccttacccgaacccgtacggaaccgaaaccggaccgtaaacccgaacccgtaaaaaccggtaggttaccggtaacctaaccgtacgtaaccgaaacctaaccgaacgtaccgacccgtaacgtacgacaaccnccgaactacgtactacgtactcgccaggaccgaggtcggtagtcggtgggtcggtacgacgtcgggtacggtacggacggtccggtacgtaccgtaccgtctccgacccgttaccgaccgtccctaacccgaccgtaccggtaccgttaccggtcccgttaccccgtccccggttccggacccgtccccgtgtacccccggtcggacccggtccctaccggtacccgaccggaccgtccgaaccgcccggtacccgggg

SEQ ID NO: 72005 - DNA, 973 bp, Homo sapiens
  misc_feature: GYAE6OF01D97GQ.21.26.C04.1.454.CMB.1.raw
  modified_base (158)..(158): a, c, t, g, unknown or other
  misc_feature (158)..(158): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctcggtcccacgctaggtacgaaaccanagacgaccctacgacgctagaccttcgcctaccttcgttcgttcggttttccacttacgacgtaacctcgtcgacgtgggttgggtggtcggtacgttacggtaccttcccggtacccgaacccgggaccccccgggaaaggccccgggagttcggtctcgcctacttacttagtttagtaggaatgtacgtacgtaacctaacccacgttaccaccgtacccattccgtacgtacggaccggtacgtcgccctaccgaccgacgaccgaacgaaccaacccgaactaaaaccggtacggtcctaacccagtaccaacgaaccaagccgtacccgaccgtagtaacgaccgtaacccacgtaacctaaaccgtaagttaccgaccggttgtaacccggaacggtaaccggggtcgggtaacggtttcccgggaagggtttcggggttagggaacccgggttacggggttaaccggggtaccccggggtacgggtaaaccgggtttcccggtttacccgggtaccccgggttaccccgtaaccggttttccccgtcccggttaaccccgtaccccggggttaaccccctaccccggttaaacccggggttacccccgggttaccccgtttaccccgggttccccccgttttaccccccgggtccccggttaaccgggttcccccccgttaaccgggaccggtttacccccgggtaccccgggtttaaccgggacccccgttaaacccccggtacccgggttacccggggtaaaccccggacccccttcccggggggaaaccccgttcccccggggg

SEQ ID NO: 72006 - DNA, 795 bp, Homo sapiens
  misc_feature: GYAE6OF01BPAU0.21.26.C04.1.454.CMB.1.raw
  modified_base (128)..(128): a, c, t, g, unknown or other
  misc_feature (128)..(128): n is a, c, g, or t
  modified_base (468)..(468): a, c, t, g, unknown or other
  misc_feature (468)..(468): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggngtctggtcccacggctaggtacgaaacccacagacgaccctcacgctgacctgctaccttctcgttcggttttcactcacgtaccactcgcgtaggtgggtggtacgggtcgtcggtacgtcccggtaccgaacccgggaacccccgggaaacgggccccggtaggtcggtccttcgaccgtaccttacttagtttacgtaggtaactggactagaactaaccactaccacgtcctatcgtacgtaggacgacctcgcctacccaccgtacgaacgaaccgaccaacccgaacgaaacgtcggtacgtaccaacgacgactaacgacgtacgaccgaccncgaacgacacgacacctactactaccgtagtcggtacgaaccgtacgtaacggggtaggtcgggtacgggttacggggtacggaacgggttaaccgtacggggtaccgggtacccgtaacggggtccgttacccggttcggaaccccgtttccgtccgtaccctaccggtaacccgtacccgtaaccccggaacggtaaccccggcccgttaacccggttcccgtcccccttaccccggccggtcccgtcctaccgggtaccccgtccggaaccgggccccttaacccgggcccgtacggtagaccccacgggtacccgaccccggg

SEQ ID NO: 72007 - DNA, 176 bp, Homo sapiens
  misc_feature: GYAE6OF02JCD1O.21.26.C04.1.454.CMB.1.raw
  modified_base (174)..(176): a, c, t, g, unknown or other
  misc_feature (174)..(176): n is a, c, g, or t
tcagtcgtcgctcgcacgaccggtgctcgatttagtctagcgactttgggtttgggggaagaggaagactgacggccctgctccaggagcacctccgagagcacagcggccctgggctgcctggcaaggactacttccctcgtctctactgagcgggctggcaaggcgcatagnnn

SEQ ID NO: 72008 - DNA, 175 bp, Homo sapiens
  misc_feature: GYAE6OF02GNDEE.21.26.C04.1.454.CMB.1.raw
  modified_base (175)..(175): a, c, t, g, unknown or other
  misc_feature (175)..(175): n is a, c, g, or t
tcagtcgtcgctcgcacgaccggtgctcgatttagtctagcgactttgggtttgggggaagaggaagactgacggccctgctccaggagcacctccgagagcacagcggccctgggctgcctggtcaaggactacttccctcgtctctactgagcgggctggcaaggcgcatagn

SEQ ID NO: 72009 - DNA, 214 bp, Homo sapiens
  misc_feature: GYAE6OF02GHAAW.21.26.C04.1.454.CMB.1.raw
  modified_base (175)..(214): a, c, t, g, unknown or other
  misc_feature (175)..(214): n is a, c, g, or t
tcagtcgtcgctcgcacgaccggtgctcgatttagtctagcgactttgggtttgggggaaggaggaagactgacggcctgctccaggagcacctccgagagccacagcggccctgggctgcctggtcaaggactacttcctcgtctctactgagcgggctggcaaggcgcatagnnnnnnnnnnnnnnnnnnnnnnnnnnnnnnnnnnnnnnnn

SEQ ID NO: 72010 - DNA, 177 bp, Homo sapiens; identical to SEQ ID NO: 71826
  misc_feature: GYAE6OF02I0L0X.21.26.C04.1.454.CMB.1.raw
  modified_base (175)..(177): a, c, t, g, unknown or other
  misc_feature (175)..(177): n is a, c, g, or t

SEQ ID NO: 72011 - DNA, 176 bp, Homo sapiens
  misc_feature: GYAE6OF02GNHYG.21.26.C04.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagtctagcgactttgggttttgggggaagaggaagactgacggccctgctccaggagcacctccgagagcacagcggccctggactgcctggtcaaggactacttccctcgtctctactgagcgggctggcaaggcgcatagn

SEQ ID NO: 72012 - DNA, 536 bp, Homo sapiens
  misc_feature: GYAE6OF02IYJE5.21.26.C04.1.454.CMB.1.raw
  modified_base (346)..(346): a, c, t, g, unknown or other
  misc_feature (346)..(346): n is a, c, g, or t
  modified_base (449)..(449): a, c, t, g, unknown or other
  misc_feature (449)..(449): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgccaaaaaccnggtggtcctaacactgaccaacactcggaccccatggacacagccaacataactactgtcgcacgacgggagtggctgggtgtgggactacgtgggccagggngtcctggtcaccgtctcctcagcctcaccaaggcccatcgtcttcccctggccgccctgcctccagcgcacctccgagacgcacacg

SEQ ID NO: 72013 - DNA, 177 bp, Homo sapiens; identical to SEQ ID NO: 71826
  misc_feature: GYAE6OF02FNCOD.21.26.C04.1.454.CMB.1.raw
  modified_base (175)..(177): a, c, t, g, unknown or other
  misc_feature (175)..(177): n is a, c, g, or t

SEQ ID NO: 72014 - DNA, 177 bp, Homo sapiens; identical to SEQ ID NO: 71826
  misc_feature: GYAE6OF02FFMMM.21.26.C04.1.454.CMB.1.raw
  modified_base (175)..(177): a, c, t, g, unknown or other
  misc_feature (175)..(177): n is a, c, g, or t

SEQ ID NO: 72015 - DNA, 176 bp, Homo sapiens
  misc_feature: GYAE6OF02GZIBW.21.26.C04.1.454.CMB.1.raw
  modified_base (175)..(176): a, c, t, g, unknown or other
  misc_feature (175)..(176): n is a, c, g, or t
tcagtcgtcgctcgcacgaccggtgctcgatttagtctagcgactttgggtttgggggaagaggaagactgacggccctgctccaggagcacctccgagagcacagcggccctgggctgcctggtcaaggactacttccctcgtctctactgagcgggctggcaaggcgcatagnn

SEQ ID NO: 72016 - DNA, 564 bp, Homo sapiens
  misc_feature: GYAE6OF02IF4MP.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttgggggaaggaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggacaccgaccaaaaaccnggtcggtacctaacactgaaccaacatcggaccccatggacacagaccacaatactactgtgcacgacgggagtggcgtgggtgtgggactacgtggggaccagggacgtccgtggtccaccggtctcctcacgcctaccacgaacgggccagtccggtccttccccgtggccgccctgcctaccgacggcgccacccgtcgaacgcgcacgacgg

SEQ ID NO: 72017 - DNA, 617 bp, Homo sapiens
  misc_feature: GYAE6OF02GVF4A.21.26.C04.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcagtgggtgtgggctggatccgtcacgccccccggaaaggccccggagtggcttgcactcatttattggaatgatgataaccactacagcccatctctgaggaccaggctcaccctcacgaagacaccgaccaaaaccaggtgtacctaacactagaaccaacatcggaccccatcggacacagccacatactactgngcacgacgggagtggcgtgggtgtgggactacgtcggggccgagggacgtccgtcggtccaccgtcctaccgtcgacgcccgtcccgaaccaacggggcccaacgttcccggttacccgttccccccgtcgggtacccggtcccccgttacggtcccgtcccgaacgggaccgtacccgtacccgtcccggacggaccgccgaaccgaccggg

SEQ ID NO: 72018 - DNA, 566 bp, Homo sapiens
  misc_feature: GYAE6OF02FVQUU.21.26.C04.1.454.CMB.1.raw
  modified_base (346)..(346): a, c, t, g, unknown or other
  misc_feature (346)..(346): n is a, c, g, or t
  modified_base (518)..(518): a, c, t, g, unknown or other
  misc_feature (518)..(518): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgccaaaaaccnggtggtacctaacactgaccaacatcggaccccatggacacagccacatactactgtgcacgacgggagtggctggggtgtgggactacgtggggccaggggacgtccgtggtaccaccggttctccgtcacgccctccaccgaacgggcccaagtccggtccttcccccgnggccgtccctgcctccgaggacgccacccgtccgagacgccacgacgg

SEQ ID NO: 72019 - DNA, 573 bp, Homo sapiens
  misc_feature: GYAE6OF02HUPT4.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccttcacgcccccggaaaggccccggagtggcttgcactcatttattggaatgatgataaccactacagcccatctctgaggaccaggctcaccctcacgaaggacaccgaccaaaaaccaggtggtcctaaacactgaccaacatggaccccatcggacacagaccacatacctactgtgacacgacgggagtggctggggtcgtgggactacgtcggggccagggagtcctggtccaccggtcctcctcacgcctacccgacaacgggccacgttccgtccttcccccgtggcccgcccttcgcctcccgacggacgccacccgtaccgacgacgccacgaccgg

SEQ ID NO: 72020 - DNA, 566 bp, Homo sapiens
  misc_feature: GYAE6OF02GIY1C.21.26.C04.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgccaaaaaccnggtgtacctaacactagaccaacatcggaccccatcggacacagccacatactactgtgcacgacgggagtggctggggtgtgggactacgtggggccaggggacgtccgtggtccaccgtctcctcacgccctccaccaacgggcccagtccggtccttccccgtggcccgccctgcctcccgacggacgcctacccgtccggacgacgaccacgacgg

SEQ ID NO: 72021 - DNA, 584 bp, Homo sapiens
  misc_feature: GYAE6OF02IZZNR.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccnggtggtacctaacactcgaccaacatggaccccatcggacacagccacactactactgtgcaacgacgggagtggctgggtgtgggactacgtggggccagggacgtccgtggtccaccgtctcctcgacgccctccgaaccgaacgggccccaagtccggtcccttcccccgtggcccgtccccgtcgcccgtcccgaagggaccgccgacccgtccggacgacgccacgaccgg

SEQ ID NO: 72022 - DNA, 579 bp, Homo sapiens
  misc_feature: GYAE6OF02HCKKU.21.26.C04.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagtctagcgactttgggtttggggggtaaggaggaagacgtgacggtccgtgcgtgctgaccatcccttctagtgggtcttggtcccagatcacccttgaaggagtctggtcccacgctggtgaaacccacagagaccctcacgcgtgacctgcaccttctctgggttttcactcagtaccactgcagtgggtgtgggctggatccgtcagccccccggaaaggccccggagtggcttgcactcatttattggaatgatgataaccactacagccccatctctgaggaccaggctcaccctcacgaaggacaccgccaaaaaccnggtcggtcctaacactgaccaacatcggaccccatcggacacagccacatacctactgtcgcacgacgggagtggcgtgggtgtcgggactacgtggggccaggggacgtccgtggtccacccgtcctcctcacgccctccaccgaagggcccagtccggtccttccccgtggcccgtccctgcctccgaggacgccacccgtccgacgcgccacgaccgg

SEQ ID NO: 72023 - DNA, 563 bp, Homo sapiens
  misc_feature: GYAE6OF02HF210.21.26.C04.1.454.CMB.1.raw
  modified_base (348)..(348): a, c, t, g, unknown or other
  misc_feature (348)..(348): n is a, c, g, or t
  modified_base (371)..(371): a, c, t, g, unknown or other
  misc_feature (371)..(371): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagccccatctctgaggaccaggctcaccctcacgaaggacaccgaccaaaaaccnggtggtcctaacactagaccaanatggaccccatggacacagccacatactactgtgcacacgggagtggctgggtgtgggactacgtggggccagggacgtccgtggtcaccgtctcctcagccctccaccgaacgggcccaagtccggtccttcccccgtgggcccgcccgtcgcctcccgacggacgccacccgtccgagacgcaccgacgg

SEQ ID NO: 72024 - DNA, 555 bp, Homo sapiens
  misc_feature: GYAE6OF02H24LZ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggacaccgccaaaaaccaggtggtcctaacactgaccaacatggaccccatcggacacagccacatactactgtgcacacgggagtggctgggtgtgggactacgtgggccagggctccgtgtccaccgtctcctcgacgccctccaccgaacggcccacgtccgtcccttccccgtggcccgcccgtcgcctccgaggcgccaccgtcgacgacgccacgaccgg

SEQ ID NO: 72025 - DNA, 583 bp, Homo sapiens
  misc_feature: GYAE6OF02JKFON.21.26.C04.1.454.CMB.1.raw
  modified_base (344)..(344): a, c, t, g, unknown or other
  misc_feature (344)..(344): n is a, c, g, or t
  modified_base (400)..(400): a, c, t, g, unknown or other
  misc_feature (400)..(400): n is a, c, g, or t
  modified_base (517)..(517): a, c, t, g, unknown or other
  misc_feature (517)..(517): n is a, c, g, or t
tcagtcgtcgctcgcacgaccggtgctcgatttagtctagcgactttgggtttgggggaaggaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcagtgggtgtgggctggatccgtcacgcccccggaaaggccccggagtggcttgcactcatttattggaatgatgataaccactacagcccatctctgaggaccaggctcaccctcacgagacaccgacaaaaaccnggtgtcctaacactgaccaacatggaccccatggacacagccaacatactactggncacacgggatggcgtgggtagtcgggactacgtcggggaccaggggatccgtggtccgaaccgttctcctacgacgtccctaccgaccaacgggccctaagtccgtccttcccccgnggtcccgtcccttacggcctcccgtaacggacggcctacccgtccggaacgacgtccgaccacggg

SEQ ID NO: 72026 - DNA, 556 bp, Homo sapiens
  misc_feature: GYAE6OF02F9BYH.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccnggtcgtacctaacactgaaccaacatcggaccccatcggaacacagccaacatactactgtgcaacacgggagtggcgtgggtgtgggactacgtggggccagggcgtccgtggtcaccgtctcctcacgcctccaccgaagggcccagtccggtccttccccgtggccgtccctgcctccgaggacgccacctccgagcgccacgcgg

SEQ ID NO: 72027 - DNA, 569 bp, Homo sapiens
  misc_feature: GYAE6OF02GINCR.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaagacaccgaccaaaaaccnggtcggtcctaaacactgaccaaacatcggaccccatcggacacagccacatactactgtcgcacgacgggagtggctgggtgtgggactacgtggggccagggacgtccgtggtccaccgtctcctcacgccctccgaccgaacgggcccagtccggtccttccccgtggccgtcccgtcgccgtccgaggacgccaccgtccggacgacgccacgaccgg

SEQ ID NO: 72028 - DNA, 575 bp, Homo sapiens
  misc_feature: GYAE6OF02G44IH.21.26.C04.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcacctcacgaaggacaccgaccaaaaccnggtcgtacctaacactgaccaacatcggaccccatcggacacacgccacatactactgtgcacgacgggagtggcgtgggtgtgggactacgtcggggccagggcgtccgtggtccaccgtctcctcgacgcctaccgaccgaacgggcccaagtccggtcccttccccgtggcccgtcccgtcgccctccgacggacgccgacccgtccgacggacgccgacgtaccgg

SEQ ID NO: 72029 - DNA, 586 bp, Homo sapiens
  misc_feature: GYAE6OF02IM0JQ.21.26.C04.1.454.CMB.1.raw
  modified_base (349)..(349): a, c, t, g, unknown or other
  misc_feature (349)..(349): n is a, c, g, or t
  modified_base (453)..(453): a, c, t, g, unknown or other
  misc_feature (453)..(453): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctcaccgaaggacaccgaccaaaaaccgnggtacggtacctaaacactacgaaccaacatcggaaccccatacggacacagccacatacctactgtcgacacgacgggagtggcgtggggtgtgggactacgnggggtccagggacgtccgtggcctaccgtctcctcgagccctaccaccgaacgggcccagtccggtccttccccgtcggccgccctcgcctaccgacggacgccaacccgtccgaacgacgccgaccgtacgg

SEQ ID NO: 72030 - DNA, 561 bp, Homo sapiens
  misc_feature: GYAE6OF02G46UQ.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggacaccgccaaaaaccnggtggtcctaacactgaccaacatcggaccccatggacacagccacatactactgtgcacgacgggagtggctgggtgtgggactacgtggggccaggggcgtccgtggtcaccgtctccctcgacgccctccaccgaacgggcccaagtccggtccttcccccgtggccgccctcgccctccgacggcgaccaccgtccgagacgcacgacgg

SEQ ID NO: 72031 - DNA, 563 bp, Homo sapiens
  misc_feature: GYAE6OF02IC9LD.21.26.C04.1.454.CMB.1.raw
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (559)..(559): a, c, t, g, unknown or other
  misc_feature (559)..(559): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctntgaggaccaggctcaccctcacgaaggacaccgaccaaaaaaccnggtggtcctaacactgaccaaacatcggaccccatcggacaacagcccaanatactactgtcgcaacacgggagtggctgggtgtgggactacgtggggccaggggacgtccgtggtccaccgtctaccgtcacgcctccaccgaagggcccaagtccggtccttcccccgtggccgccctgcctcccgaggacgcacctccgagcgccanacgg

SEQ ID NO: 72032 - DNA, 556 bp, Homo sapiens
  misc_feature: GYAE6OF02HGMLI.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccaggtgtcctaacactgaaccaacatcggaccccatcggacacagccacatactactgtgcacgacgggagtggcgtgggtgtgggactacgtggggaccagggacgtccgtggtccaccgtctcctcacgcctccaccgacggcccagtccggtccttccccgtggcccgccctgcctccgaggacgcacccgtccgagacgcacgacgg

SEQ ID NO: 72033 - DNA, 595 bp, Homo sapiens
  misc_feature: GYAE6OF02FVP58.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccaggtcgtcctaaacactagaccaaacatcggaccccagtggacacagccacatactactgtgcacacggggagtgggcgtggggtgtgggacttacgtgggggccaggggacgtccgtgggtccaccggttctcccgtcgacgtccctccgaaccgaacgggccccagttcccggttccttcccccgtcgggcccgtccctcggccctccgacggtacgcccaccgtcccggagacgccgacgaccggg

SEQ ID NO: 72034 - DNA, 558 bp, Homo sapiens
  misc_feature: GYAE6OF02IC01S.21.26.C04.1.454.CMB.1.raw
  modified_base (347)..(347): a, c, t, g, unknown or other
  misc_feature (347)..(347): n is a, c, g, or t
  modified_base (378)..(378): a, c, t, g, unknown or other
  misc_feature (378)..(378): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaacnggtgtcctaacactgaccaacatgaccccanggacacagccacatactactgtgcacacgggagtggcgtgggtgtgggactacgtgacggccgagggagtccgtggtcaccgtctcctcacgccctaccaccgaacgggcccagtcccggtccttcccccgtggcccgtccctcgcctcccgaggcgccgaccctccggagacgcaaccg

SEQ ID NO: 72035 - DNA, 586 bp, Homo sapiens
  misc_feature: GYAE6OF02GM8A5.21.26.C04.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctcacgaaggacaccgaccaaaaaccnggtggtacctaacactgaaccaacatcggaccccatcggacacagccacatactactgtgcacacgggagtggctgggtgtgggactacgtcggggccaggggactccgtggtccacccggttctccctcgacgccctaccgaacccgaacgggccccaagttcccggtcccttccccccgtgggcccgtcccctcgcccgtcccgaggaccgccacccgtccgagacgccacgaccggg

SEQ ID NO: 72036 - DNA, 563 bp, Homo sapiens
  misc_feature: GYAE6OF02GVNTO.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccaggtggtcctaacactgaccaacatggaccccatggacacagccacatactactgtgcacacgggagtggctggggtgtgggactacgtggggccaggggagtccgtgggtccacccggtctccctcacgccctccaccgaacgggcccagtccggtccttcccccgtggcccgccctcgcctcccgaggacgccaccgtccgagacgcacgacgg

SEQ ID NO: 72037 - DNA, 555 bp, Homo sapiens
  misc_feature: GYAE6OF02H66QK.21.26.C04.1.454.CMB.1.raw
  modified_base (345)..(345): a, c, t, g, unknown or other
  misc_feature (345)..(345): n is a, c, g, or t
  modified_base (405)..(405): a, c, t, g, unknown or other
  misc_feature (405)..(405): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggcccggagtggcttgcactcatttatggaatgatgataaccactacagcccatctctgaggaccaggctcaccctcacgaaggacaccgaccaaaaaccnggtggtcctaacactcgaccaacatcggaccccatacggacaacagccacatactactgngcacacgggatggctgggtgtgggactacgtggggccaggggacgtcgtggtcaccgtctcctcacgtccctaccactaacgggccacgtccggtccttacccccgtggccgcctcgctcccgaaggcgcacctccgagacgccacacgg

SEQ ID NO: 72038 - DNA, 569 bp, Homo sapiens
  misc_feature: GYAE6OF02HPZCV.21.26.C04.1.454.CMB.1.raw
  modified_base (521)..(521): a, c, t, g, unknown or other
  misc_feature (521)..(521): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggaccaaccgaccaaaaaccaggtcggtacctaacactgaaccaacatcggaccccatcggacacagaccacatactactgtgacacgacgggagtggctgggtgtgggactacggtggggccagggcgtccgtggtccaccgtcctccgtcacgccctccaccgaacgggcccagtccgtccttccccgnggcccgccctgcctccgacggacgccacccgccgagcgccacgaccgg

SEQ ID NO: 72039 - DNA, 571 bp, Homo sapiens
  misc_feature: GYAE6OF02F1AEF.21.26.C04.1.454.CMB.1.raw
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
  modified_base (438)..(438): a, c, t, g, unknown or other
  misc_feature (438)..(438): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttacnggaatgatgataaccactacagcccatctctgaggaccaggctcaccctcacgaaggacaccgaccaaaaaccnggtgtacctaacactagaccaacatggaccccatggacacagccacatactactgtagcacacgggagtggcgtgggtgtgggactacgngggccagggagtcctggtccaccgtctcctcacgcctcccaaccgaacgggccctaacgtccggtaccttcccccgtgggccgtcccctgcccgtcccgaggacgccacccgtcccggagacgccacgaccgg

SEQ ID NO: 72040 - DNA, 192 bp, Homo sapiens
  misc_feature: GYAE6OF02HNHQX.21.26.C04.1.454.CMB.1.raw
  modified_base (181)..(192): a, c, t, g, unknown or other
  misc_feature (181)..(192): n is a, c, g, or t
tcagtcgtcgctcgcacgaccggtgctcgatttagtctagcgactttgggttttggggggaagaggaagactgacggccctgctccaggagctacctccgagtagcacagcggccctggggctgcctggtcaaggactacttccctcgtctctactgagcgggctggctaaggcgcatagnnnnnnnnnnnn

SEQ ID NO: 72041 - DNA, 562 bp, Homo sapiens
  misc_feature: GYAE6OF02H2ZHB.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccnggtggtcctaacactgaccaacatcggaccccatcgacacagccacatactactgtgcacgacgggagtggctggggtgtggggactaccgtggggccagggacgtccgtggtccaccgtctcctcacgccctccaccgaacgggcccagtccgtccttcccccgtggcccgccctgcctccgacggcgccaccgtccgagacgccacgaccgg

SEQ ID NO: 72042 - DNA, 592 bp, Homo sapiens
  misc_feature: GYAE6OF02IXEPE.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctccaccctcacgaacggacaacccgaccaaaaaccnggtacggtacctaacactacgaaccaacactacggaccccatggaacacagccacactactactgtcgacacgacgggagtggctgggtgtacgggactacgtcggggccagggacgtccgtgtccaccgtcctaccgtcacgtcctccgaaccgaacgggcccctagtccgtcccttccccgtggcccgtccgtcgcctacccgaggacgccgtaccgtccggacgacgaccacgacgg

SEQ ID NO: 72043 - DNA, 560 bp, Homo sapiens
  misc_feature: GYAE6OF02IAXJW.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttgggggggaagaggaagactgacggtcctgctgatgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaagacaccgaccaaaaaccnggtgtcctaacactgaccaacatcggaccccatcggacacagccacatactactgtgcacgacgggagtggcgtgggtggtgggactacggtcggggccgaggggacgtccgtggtccaccgtcctcctcacgcctccaccgaacggcccaagtccgtccttccccgtggccgccctgcctccgaggacgccacctccgagacgccacacgg

SEQ ID NO: 72044 - DNA, 591 bp, Homo sapiens
  misc_feature: GYAE6OF02G5HJX.21.26.C04.1.454.CMB.1.raw
  modified_base (353)..(353): a, c, t, g, unknown or other
  misc_feature (353)..(353): n is a, c, g, or t
  modified_base (492)..(492): a, c, t, g, unknown or other
  misc_feature (492)..(492): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgacccccggaaaggccccggagtggcttgcactcatttattggaatgatgataaccactacagcccatctctgaggaccaggcctcaccctcacgaacggacaacccgaccaaaaaccnggtcggtacctaacactcgaaccaaacactaggaccccagtggacacacgccaacatactactgtacgcaacgacgggagtggcgtggggtgtgggactacggtggggccaggggacgtccgtggtccaccgtctcccncacgccctaccaccgaacggcccagtccgttccctcccctggcccgtcccgtcgcctcccgaggaccgcctacccgtaccgacgacgtccacgaccggg

SEQ ID NO: 72045 - DNA, 565 bp, Homo sapiens
  misc_feature: GYAE6OF02JDY29.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctcacgaaggacaccgaccaaaaaccnggtggtcctaacactgaccaacatcggaccccatggacacagccacatactactgtgcacgacgggagtggcgtgggtgtcgggactacggtcggggccgggagtccgtggtccaccgtctcctcacgcctccaccgaacgggcccacgtccggtccttcccccgtggccgcccgtgcctcccgaggacgccaccctccgacgacgcacgagcccggg

SEQ ID NO: 72046 - DNA, 579 bp, Homo sapiens
  misc_feature: GYAE6OF02I0IT3.21.26.C04.1.454.CMB.1.raw
  modified_base (348)..(348): a, c, t, g, unknown or other
  misc_feature (348)..(348): n is a, c, g, or t
  modified_base (529)..(529): a, c, t, g, unknown or other
  misc_feature (529)..(529): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggcctcaccctcacgaaggacaccgaccaaaaaccnggtagtcctaacactgaccaacatcggaccccatcggacacagccaacaatacctactgtcgacacgaacgggagtggctggggtgtagggactacggtggggaccaggggacttccgtggtaccgaccgtcctccctcgacgccctccaccgaacgggcccagtcccggtccttccccgnggccgtccctcgcctccgacggacgccaccgtccgacgacgcaccgacgg

SEQ ID NO: 72047 - DNA, 177 bp, Homo sapiens
  misc_feature: GYAE6OF02H222Z.21.26.C04.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagtctagcgactttgggttttggggggaagaggaagactgacggccctgctccaggagcacctccgagagcacagcggccctgggctgcctggtcaaggactacttccctcgtctctactgagcgggctggcaaggcgcatagn

SEQ ID NO: 72048 - DNA, 645 bp, Homo sapiens
  misc_feature: GYAE6OF02I74OX.21.26.C04.1.454.CMB.1.raw
  modified_base (239)..(239): a, c, t, g, unknown or other
  misc_feature (239)..(239): n is a, c, g, or t
  modified_base (298)..(298): a, c, t, g, unknown or other
  misc_feature (298)..(298): n is a, c, g, or t
  modified_base (571)..(571): a, c, t, g, unknown or other
  misc_feature (571)..(571): n is a, c, g, or t
tcagtcgtcgctcgcacgaccggtgctcgatttagtctagcgactttggggtttgggggggaagagggaagactgacggtcctgctgctgaccatcccttcatgggtcttgtcccagatcaccttgaaggagtctggtccacgctggtgaaacccacagacgaccctcacgctgacctcgcaccttcttcttgggttttctactcacgtaccactgcaggtgggtggtgggcgtggacncggtcacggcccccggaaaggccccggagtcggcttgcactcatttattggaatgatgnataacactacagaccatctctgaggaccaggctacacctacacgaacgacaaccgaccaaaacacgtacgtactaacactacgaccaacacacgaccactacgacacacacacactactactagtagacacgacggacgtaggacgtagggtaggtacgggacgtacgtacggggaccggacgggacggtacggtacggtacgtaccgtaccgtacccgaccgtaccgtaccaccgaacggaccgacgtaccgtaccgttaccccgtaccggnccgtacccgtaccggtaccgtacccgtacggaaccggtacccgtaacccggtacccggtaccggaccggaaccg

SEQ ID NO: 72049 - DNA, 576 bp, Homo sapiens
  misc_feature: GYAE6OF02FV24W.21.26.C04.1.454.CMB.1.raw
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccactctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctnacgaagacaccgaccaaaaacnggtgtcctaacactgaccaacatcggaccccatcggacacagccacatactactgtgcacacgggagtggcgtgggtgtgggactacgtggggcagggacgtccgtggtccaccggttctcctcgacgcctccaaccgacgggcccacgttccggtcctttcccccgtggcccgtccccgtgtccctccgacggaccgcctacccgtcccgaggtaccgccaccgaccgg

SEQ ID NO: 72050 - DNA, 569 bp, Homo sapiens
  misc_feature: GYAE6OF02JCGGF.21.26.C04.1.454.CMB.1.raw
  modified_base (349)..(349): a, c, t, g, unknown or other
  misc_feature (349)..(349): n is a, c, g, or t
  modified_base (398)..(398): a, c, t, g, unknown or other
  misc_feature (398)..(398): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggaccaccgaccaaaaaccnggtcgtacctaacactgaaccaacatacggaccccatggacacagccanactactactgtgcacgacgggagtggcgtgggtgtgggactacgtggggccagggacgtccgtggcaccgtctcctcacgcctaccaccgaacgggcccaagtccggtccttccccgtggcccgtccctgcccgtccgacggacgccacccgtccgagacgccacgaccgg

SEQ ID NO: 72051 - DNA, 566 bp, Homo sapiens
  misc_feature: GYAE6OF02GDM9O.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggaccaccgaccaaaaaccnggtcggccctaaacactgaccaacactcggaccccatcggacacacgccacatactactgtgcacgacgggagtggcgtgggtgtgggactacgtggggccgagggacgtccgtggtccaccgtcctcctcgacgccctccaccgaacggcccagtccgtccttccccgtggccgccctcgcctccgacggcgccaccgtccgagcgacacgaccgg

SEQ ID NO: 72052 - DNA, 585 bp, Homo sapiens
  misc_feature: GYAE6OF02F1S8G.21.26.C04.1.454.CMB.1.raw
  modified_base (346)..(346): a, c, t, g, unknown or other
  misc_feature (346)..(346): n is a, c, g, or t
  modified_base (405)..(405): a, c, t, g, unknown or other
  misc_feature (405)..(405): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctcacgaaggacaccgaccaaaaaccnggtacgtcctaacactgaccaacatcggaccccatcggacacagccacatactactgtncacacgggagtggctgggtgtgggactacgtgggccagggcgtccgtggtccaccgtcctcctcacgccctcaccgaacgggcccagtccggtcccttcccccgtggcccgtcccctcggcccttccgacgggtaccgccgtaccccgttcccggaacgtaccgaccgaccgtacccggg

SEQ ID NO: 72053 - DNA, 592 bp, Homo sapiens
  misc_feature: GYAE6OF02GHXEU.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgacggaccaggctcaccctcacgaagacaccgaccaaaaaccnggtacggtcctaacactgaccaacatcggaccccatcggacacagccacactactactgtgcaacgacgggagtggctggggtgtgggacttacgtggggccagggacgtccgtggtccaccgtctcctcgacgcctaccaaccgaacgggccctaacgtccggtccctttccccgtggcccgccccgttcgccctcccgagggtaccgcccaccggtcccggaacgacgacccacgtaccggg

SEQ ID NO: 72054 - DNA, 621 bp, Homo sapiens
  misc_feature: GYAE6OF02GKC02.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggacaccgaccaaaaaccnggtacgtacctaacactacgaaccaacagtacggaccccagtcggaacacacgccaacactaactactgtgacacgacgggagtggcgtgggtgtagggactacggtgggccgagggtacgtccgtggtccaccgttccgtccgtcgacgtccctaccgaaccgaacgggccctaaggtcccggttcccttacccccgtcggcccgtcccctcggtcccgtacccgacggaccgtaccgacccgtacccgaggaccgccgaccgtacccggg

SEQ ID NO: 72055 - DNA, 585 bp, Homo sapiens
  misc_feature: GYAE6OF02J1DVI.21.26.C04.1.454.CMB.1.raw
  modified_base (350)..(350): a, c, t, g, unknown or other
  misc_feature (350)..(350): n is a, c, g, or t
  modified_base (530)..(530): a, c, t, g, unknown or other
  misc_feature (530)..(530): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaacggaccaaccgaccaaaaccnggtacggtacctaacactgaacccaacacgtcggaccccatcggaccacgacgcccaacactaactactgtacgcaacgacgggagtggcgtgggtgtgggacgtacgtggggccgagggacgtcgtggtccaccgtctcctcacgcctaccaccgacggcccagtccgtccttccccgnggccgccctcgctaccgacgaccgccgacccgtccgacgacgaccgacgaccggg

SEQ ID NO: 72056 - DNA, 556 bp, Homo sapiens
  misc_feature: GYAE6OF02IXJUZ.21.26.C04.1.454.CMB.1.raw
  modified_base (345)..(345): a, c, t, g, unknown or other
  misc_feature (345)..(345): n is a, c, g, or t
  modified_base (510)..(510): a, c, t, g, unknown or other
  misc_feature (510)..(510): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctcacgaaggacaccgccaaaaaccnggtcggtacctaacactgaccaacatcggaccccatcggacacagccaacatactactgtgcacacgggagtcggctggggtgtgggactacgtggggccagggagtccgtggtccaccgtctcctcacgcctccaccaagggcccagtccggtccttcccccgnggcccgccctcgcctccgaggcgccaccgtccgagacgccacacgg

SEQ ID NO: 72057 - DNA, 599 bp, Homo sapiens
  misc_feature: GYAE6OF02GG7ZS.21.26.C04.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggaccacccgaccaaaaaccnggtcggtaccctaacactacgaaccaacactacggaccccatcggaccacacgccacactactactgtgcacgacgggagtggctggggtgtcgggactacggtggggccgagggtacgtccgtggtccaccgttctaccgtcgacgccctccaccgacgggcccagtccgtcccttccccgtggcccgtccctcgccctaccgacggacgtacccgacccgtccggaacgaccggccacgtaccggg

SEQ ID NO: 72058 - DNA, 611 bp, Homo sapiens
  misc_feature: GYAE6OF02FW1MB.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaagacaccgaccaaaaaccnggtcggtacctaacactagaaccaacatacggaccccatcggaccacacgccaacactaactactcgtcgcacgacgggagtggcgtgggtgtgggactacgtcggggaccagggacgtccgtggtccgaccgttctccgtcacgccctaccgaccgaacgggcccctacgtccggttcccttcccccgtggcccgtcccgtcggcccgttcccgacgggaccgaccgtacccgtaccggacgaccgtaccgaccgtacccggg

SEQ ID NO: 72059 - DNA, 610 bp, Homo sapiens
  misc_feature: GYAE6OF02I0WW1.21.26.C04.1.454.CMB.1.raw
  modified_base (349)..(349): a, c, t, g, unknown or other
  misc_feature (349)..(349): n is a, c, g, or t
  modified_base (458)..(458): a, c, t, g, unknown or other
  misc_feature (458)..(458): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagccatctctgacggaccaggctccaccctcaacgaagacaccgaccaaaaaccnggtcggtacaacactgaaccaacatacggaccccagtaggaacacacgaccacaactactactgtacgacaacgacggggagtgggacgtgggtggtgggacgtacggnggggccgacggggacgtccgtggtccaccggtctcccgtcacgccctaccaccgaacggccctaacgtccggttcccttacccccgtggcccggtaccctcggccgtaccgacggacgaccgacccggtaccgagacgaccgtacgaccggg

SEQ ID NO: 72060 - DNA, 594 bp, Homo sapiens
  misc_feature: GYAE6OF02FLWKW.21.26.C04.1.454.CMB.1.raw
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctnacgaggacaccgccaaaaaccnggtcgtcctaacactgaccaacatcggaccccatcggacacagccacatactactgtgcacacgggagtggctggggtcgtgggactacgtggggccaaggggcgtccgtggtccaccggttcctcccttcgacgtccctcccgaaccgaacgggccccaagttcccgggtaccctttccccccggtggcccgtaccccgtgcccttaccgacggacgccacccgtccggaacgacgaccgactacggg

SEQ ID NO: 72061 - DNA, 589 bp, Homo sapiens
  misc_feature: GYAE6OF02G3WPZ.21.26.C04.1.454.CMB.1.raw
  modified_base (352)..(352): a, c, t, g, unknown or other
  misc_feature (352)..(352): n is a, c, g, or t
  modified_base (554)..(554): a, c, t, g, unknown or other
  misc_feature (554)..(554): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctccaccctcacgaaggaccacccgaccaaaaaccnggtcggtacctaacactgaccaacatggaccccatggacacagccacatactactgtgcacacgggagtggctgggtgtgggactacgtcggggaccaggggatccgtggtcaccgtcctcctcacgtccctccaaccgacgggccctagtcccggtcccttcccccgtggcccgtcccctcggtccctcccgacgggtacncccgtacccgtccggaacggtacgccacgaccggg

SEQ ID NO: 72062 - DNA, 901 bp, Homo sapiens
  misc_feature: GYAE6OF02GB5PL.21.26.C04.1.454.CMB.1.raw
tcagtcgtcgctcgcacgaccggtgctcgatttagtctagcgactttgggtttggggggaacgaaggaacgactgaccggtccctgctagccctgaccatcccttacactcgggtcttggtccccaggacttcgaccgttgaacggtagtttcgtgggtcccacgctggtcgaaacccacgagacgaccctccacgctgacctgcaccttctctgggtttcactcagtaccactcgcgacgtgggtgtgggacgttcggagtccgtcgacgtccccccggaaaggccccggagtcggtcttgcgactcattttattggaattggatggactaaccgacccgtaacaaggcccctagtctcgtggaggaccagggcttccaccctcacggaacgacaccggaaccaaaaaccgaaggttacggtacctaaacgaaccttacgaaccgaaacaacgtacgggaaccccctaacgttacggaacgaaccaacgaccctaaccgaacgttaaccgttaaccttacggttacgaccgtaaccgaacgggggtacggttacgggtaccgtacgggggttacggttacgggggtaaccttaaccgggttacgggggtaccccgaaagggggtaaccggttaccccggttacgggtttacccgtaaccccggttttccgttttaccccgttaccgtaacccggtacccccttaccccgtaaacccggtaaaccgggggacccccttaacggttaccccgggtttaacccttttaccccccccggtagggtacccccgttaacccccgtttaccggtaccccgtttaccccggacggggtaacccgtaccccggtaacccccggtttcccgggaaccggtaacccggtaccctaacccggggtaccccgg

SEQ ID NO: 72063 - DNA, 587 bp, Homo sapiens
  misc_feature: GYAE6OF02IN3TZ.21.26.C04.1.454.CMB.1.raw
  modified_base (350)..(350): a, c, t, g, unknown or other
  misc_feature (350)..(350): n is a, c, g, or t
  modified_base (535)..(535): a, c, t, g, unknown or other
  misc_feature (535)..(535): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggcctcaccctcaacgaacgacaccgaccaaaaccnggtcgtacctaacactcgaaccaacactcggacccatcggacacagccacatactactgtcgacacgacgggagtcggcgtggggtgtcgggacctacggtcggggaccaggggacgttccgtggtccaccggttctcccgtcacgtccctcccaccgaacggcccagtccggtcccttccccgnggcccgccctcgcctccgaggtacgcctacccgtccggagacgccacgacgg

SEQ ID NO: 72064 - DNA, 610 bp, Homo sapiens
  misc_feature: GYAE6OF02FRMI3.21.26.C04.1.454.CMB.1.raw
  modified_base (348)..(348): a, c, t, g, unknown or other
  misc_feature (348)..(348): n is a, c, g, or t
  modified_base (539)..(539): a, c, t, g, unknown or other
  misc_feature (539)..(539): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgagaccaggctcaccctcacgaaggacaccgaccaaaaaccnggtcgtacctaacactagaccaacatcggaccccatcggacacagccacatactactgtgacacgacgggagtggcgtggggtgtgggacttacggtggggccaggggtacgtccgtggtccaccgtcctcctcgacgtccctaccaaccgggggaacgcccctaagttcccgggttccctttccccccgngggcccgtacccgtcggtccctcccgacgggacgcccgtacccgtcccggaaggacggtccaccgaccggg

SEQ ID NO: 72065 - DNA, 656 bp, Homo sapiens
  misc_feature: GYAE6OF02GDOQN.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtgggcttgcactctatttatggaatgatgataaccactacagcccatctctgaggaccaggctcaccctcacgaggacaccgaccaaaaaccnggtacgtacctaacactacgaaccaaacacgtacggaccccagtcggacacgacgaccaacactaactactgtacgcaacgacggggtaagtgggtcgtaggggttggtagggaccttacggtcggggaccgtaggggacgttcccgtgggtcctaccgttccgtaccgtcgaccgtccctacccgaaccgaaccgggtcccacgttcccgggttacccttccccccgtgggcccggtccccgtcggtacccgtccgacgggtaccgaccgaccccgtccggaacgacccgaccgtacccgaccggg

SEQ ID NO: 72066 - DNA, 587 bp, Homo sapiens
  misc_feature: GYAE6OF02HG144.21.26.C04.1.454.CMB.1.raw
  modified_base (348)..(348): a, c, t, g, unknown or other
  misc_feature (348)..(348): n is a, c, g, or t
  modified_base (467)..(467): a, c, t, g, unknown or other
  misc_feature (467)..(467): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggacaccgaccaaaaaccnggtacggtacctaacactgaccaacactacggaccccatcggaacacacgcccaacatacctactgtagcaaccgacggggagtggcgtgggtggtagggactacgtggggccaggggngtccgtgggtcaccggtctccgtcgacgcctacccacgaacggcccagtccgtccgttcccccgtggcccgcccgtcgcctcccgacggacgccacccgtccggacgacgccacgaccgg

SEQ ID NO: 72067 - DNA, 567 bp, Homo sapiens
  misc_feature: GYAE6OF02GTWC4.21.26.C04.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaagacaccgccaaaaaccnggtggtcctaacactgaccaacatcggaccccatcggacacagccacatactactgtgcacgacgggagtggctggggtgtgggactacgtggggccagggagtccgtggtccaccgttctccgtcacgccctaccgaccgaaacgggcccatccgggtccttcccccgtggccgcccttggcctccgaggacgcctacccgtccgagacgccacgtaccgg

SEQ ID NO: 72068 - DNA, 580 bp, Homo sapiens
  misc_feature: GYAE6OF02HSD7G.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactctatttattggaatgatgataaccactacagcccatctctgaggaccaggctcaccctcacgaaggaccacccgaccaaaaaccnggtcggtaccctaacactcgaaccaacactcggaccccatcggacacagccacatactactgtgcacgacgggagtggctggggtgtggggactacggtggggccaggggacgtccgtggtccaccgttctccgtcacgccctcccaccgacgggcccagtcccggtccttcccccgtggcccgtccctcgcctcccgaaggcgccaccgtccgagacgccacgccgg

SEQ ID NO: 72069 - DNA, 596 bp, Homo sapiens
  misc_feature: GYAE6OF02GRCB3.21.26.C04.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggaccaccgaccaaaaaccgnggtacggtacctaacactcgaaccaacatcggaccccatcggacacagccacatactactgtcgcacgacgggagtggcgtgggtgtcgggactacggtggggaccgagggacgtccgtggtccgaccgtctaccgtcgacgtccctccgaccgacgggcccaagtccggttccttccccgtggcccgtcccgtcgccgtccgacggacgaccgtacccgtacccggacgacgaccgacgaccgg

SEQ ID NO: 72070 - DNA, 589 bp, Homo sapiens
  misc_feature: GYAE6OF02FPK7H.21.26.C04.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagtctagcgactttgggtttggggggaagagggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggaggtggcttgcactcatttatggaatgatgataaccactacagcccatctctgaggaccaggctcaccctcacgaaggacaccgaccaaaaaccgnggtcggtacctaaacactgaaccaacatcggaccccagtacggaacacacgccacactactacgtgtgacacgacgggagtcggcgtggggtgtgggactacgtcggggccgagggacgtccgtggtccaccgtcctccgtcacgcctccgaccgaacggcccagtccgtcccttccccgtcggccgtccctcgtccgtccgacggacgaccgacccgtccgacgacgccgacgaccgg

SEQ ID NO: 72071 - DNA, 654 bp, Homo sapiens
  misc_feature: GYAE6OF02H5L6Q.21.26.C04.1.454.CMB.1.raw
  modified_base (583)..(583): a, c, t, g, unknown or other
  misc_feature (583)..(583): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgaataaccactacagcccatctctcgaggaccaggcctcaccctacacgaaggaccaccgaaccaaaaaccgaggtacggtacctaaacactacgaccaacacgtacggaaccccagtacggaccacacgacccacaacttactactgtacgccaacgacggggagtcgggcgtggggtacgtgggactacggtcggggaccgaggggtacgtccgtgggtacccgtaccggttccctccgtacgaaccgtcccgtacccaaccggaaccgggcccacgttcccggtacccttcccccggnggtcccgtcccgtaccgtcctacccggacggaccgccgacccgtaccggacggactcccgacgtacccggg

SEQ ID NO: 72072 - DNA, 581 bp, Homo sapiens
  misc_feature: GYAE6OF02GVKCH.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaagacaccgaccaaaaaccnggtacgtaccaacactgaaccaacactcggaccccatcggacacacgccacatactactgtgcacgacgggagtggcgtgggtgtcgggactacgtcggggaccgaggggacgtccgtggtccaccggtctccgtcacgcctcccgaccgaacgggcccagtccgtccttccccgcggcccgtccctcgcctccgacggacgccctaccgtaccgacgacgccgacgaccggg

SEQ ID NO: 72073 - DNA, 843 bp, Homo sapiens
  misc_feature: GYAE6OF02J22Z8.21.26.C04.1.454.CMB.1.raw
  modified_base (312)..(312): a, c, t, g, unknown or other
  misc_feature (312)..(312): n is a, c, g, or t
  modified_base (476)..(476): a, c, t, g, unknown or other
  misc_feature (476)..(476): n is a, c, g, or t
tcagtcgtcgctcgcacgaccggtgctcgatttagtctagcgactttgggtttgggggtaaggaggaaggacgtgacggtcctgctgctgaccactccttcatggtcttgtcccagatcaccttgaaggagtctggtcccacgctggtgaaacccacagacgaccctcacgctgacctgccaccttctctagggtttcactcacgtaccactgcagtggggtgtgggctaggacttccgcgaccggccccccgggaaaggcccccgggtagtggtccttcggactactcctagttttaattggaaattgtanaggtaacttaaaccccagttaaccacgcccaatcctctaggacgaccacggcctcgtacccacgacaacgggacaaccccgttcaaaaaccgagggtcgtccctaaacaactggaacccaaactagtcgggaacccctaagcggacaacccagttcccaaccgnttaaaccctcgtacgtacgaccgaacgacggacggggttacggtacggtcggggttcgggtacgggtaacccggtaacggttacgggggtaacccggaaggggtaaccgggtacgttacccgggtttcgaaaccccgggtttccttccccgtttaccgaacccggtcccggttaacccctaaaccccgggaaacccgggttccccgtaaacggttaccccgggttaccccgtttcccccggttaccgggttaccccgggtcccccgtttcccgggaaactcccccggggttaaccggaccgtaccggggtttaaccccccaccggggttaaccgtacccgggaccggttaaaccccgaccccggggg

SEQ ID NO: 72074 - DNA, 695 bp, Homo sapiens
  misc_feature: GYAE6OF02JPSWZ.21.26.C04.1.454.CMB.1.raw
  modified_base (221)..(221): a, c, t, g, unknown or other
  misc_feature (221)..(221): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
  modified_base (416)..(416): a, c, t, g, unknown or other
  misc_feature (416)..(416): n is a, c, g, or t
  modified_base (475)..(475): a, c, t, g, unknown or other
  misc_feature (475)..(475): n is a, c, g, or t
tcagtcgtcgctcgcacgaccggtgctcgatttagtctagcgactttgggtttgggggtaaggagggaagacgtgacggtccgtgctgctgaccatccttcatgggtcttgtcccagatcaccttgaaggagtctggtccacgctggtgaaacccacagagaccctcacgctcgacctgcaccttctctgggtttcactcagtaccactgcagtgggtggngggctggatccgtcacggccccccggaaaggccccgggagtggcttgcactcgtatttagttggaatgatgtactaaccatacacgccatctctggacgaccgacggctccacctccaaggacgaacaccgaaccaaaaaaccgngggtcgtacctaaacaccgngaaacccaaatacgtcggaacccctaacgnggaaccaacacgacccaactaatacctactacgtcgactaaccgcggggaattcggggngttacggggtggtacgggtaaccgtacggtaccggggtacgaacggggtacgtcgtaccgggtcgacccgttaccgttcccgacttcgggaccccttaccggaaaccctaaccggggccctaaccgtaccgttcccgttcccccgtcgggtcccgccctcggccgtaccccgtagggactcccgtaaccgacccggtaccgagtacccgaacctacgggg

SEQ ID NO: 72075 - DNA, 608 bp, Homo sapiens
  misc_feature: GYAE6OF02H4SSI.21.26.C04.1.454.CMB.1.raw
  modified_base (501)..(501): a, c, t, g, unknown or other
  misc_feature (501)..(501): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggcccggagtggcttgcactcatttattggaatgatgataaccactacagcccatctctgacggaccaggctccaccctcaacgaaacggaccaccgaaccaaaaaaccgaggtacggtacctaacactcgaaccaaacatcggaccccaagtggaaccacacgccaactaatactactgtcgacaacgacgggaggtggcgtgggtgtgggactacgtggggccagggacgtcctggtccaccgtcctcctcgacnccctccaaccgaacgggccctaacgtccggtcccttccccggtggtcccgtccctcgcccgtacccgtacggacgaccacccgtccgtaagacgtccaaccgacggg

SEQ ID NO: 72076 - DNA, 592 bp, Homo sapiens
  misc_feature: GYAE6OF02GRBFX.21.26.C04.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggcctcaccctcacgaaggacaccgaccaaaaaccgnggtcggtacctaacactgaaccaacatcgaccccatcggacacacgccacatactactgtacgcacgacgggagtcggctgggtgtgggactacggtggggccaggggtcgtaccgtggtaccacccgttcctccgtcgacgccctaccgaccgaacgggcccaagtccgtccttccccgtggcccgcccgtcgcccgtccgacggacgaccgtacccgtccggagacgaccacgacccgg

SEQ ID NO: 72077 - DNA, 595 bp, Homo sapiens
  misc_feature: GYAE6OF02JMS5E.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgagaccaggctcaccctcacgaaggaccaccgaccaaaaaccnggtagtacctaacactacgaaccaacagtacggaacccccatcggacacgacgcccaacatactactgtgacaacgacgggaagtggcgtgggtggtcgggactacgtcggggaccgagggacgtccgtggtaccaccggttctcccgttcacgtcccgtaccgaccaacgggcccacgttccgtccttccccgcggccgcccgtgcctccgacggagcccaccgtccgacgacgccacgtaccgg

SEQ ID NO: 72078 - DNA, 575 bp, Homo sapiens
  misc_feature: GYAE6OF02IBHQQ.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggatgatgataaccactacagcccatctctgaggaccaggctcaccctcacgaagacaccgaccaaaaaccnggtggtacctaacactcgaaccaacatcgaccccatcgacacagccacatactactgtgcacgacgggagtggcgtgggtgtgggactacgcgggccagggacgtcgtggtccaccgtctcctcacgcctccaccgacggcccacgtccgtcccttcccccgtcggcccgccccgtcgccgtcccgacggcgcccgacccgtccgaacggaccggccacgtacccggg

SEQ ID NO: 72079 - DNA, 620 bp, Homo sapiens
  misc_feature: GYAE6OF02GSKB8.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacacgcccatctctgaggaccagctccacctcacgaagacaccgaccaaaaaccgnggtacgtacctaacactacgaaccaacacgtacggaaccccagtacggacacacgacccaacatactactgtcgcacgacgggagtgggcgtgggtggtcgggactacggtggggccaggggtacgtcgtggtaccaccgttcaccgtcacgcccgtaccgaaccgacgggccccaacgttcccgggttcccttcccccgtgggtccccgtcccgtcggccctcccgacggaccgccgtaccccgtaccggacggaccgaccacggaccgg

SEQ ID NO: 72080 - DNA, 569 bp, Homo sapiens
  misc_feature: GYAE6OF02FSHSP.21.26.C04.1.454.CMB.1.raw
  modified_base (323)..(323): a, c, t, g, unknown or other
  misc_feature (323)..(323): n is a, c, g, or t
  modified_base (405)..(405): a, c, t, g, unknown or other
  misc_feature (405)..(405): n is a, c, g, or t
  modified_base (516)..(516): a, c, t, g, unknown or other
  misc_feature (516)..(516): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctnacgaaggacaccgaccaaaaccaggtcgtcctaacactgaccaacatcggaccccagtcggacacagccacatactactgtncacgacgggagtggctggggtgtgggactacgtgggccgagggcgtccgtggtccaccgtcctcctcacgccctccgaccgaacgggccccagtcccggtccttcccccgnggtcccgcccgtgccctccgaggacgccaccgtcccgagaccgccacgaccgg

SEQ ID NO: 72081 - DNA, 643 bp, Homo sapiens
  misc_feature: GYAE6OF02ISJL9.21.26.C04.1.454.CMB.1.raw
  modified_base (354)..(354): a, c, t, g, unknown or other
  misc_feature (354)..(354): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgaactaaccactacacgcccatctctgaggaccaggctccaccctcacgaagaccaccgaccaaaaaccgnggtacgtacctaacactacgaaccaacacgtacggaccccagtcggaacacgacgaccaacacttaacctactgtacgacaacgacgggagtcgggtcgtaggggttcggtacgggacgttacggtcgggggaccgacggggacttccgtcggtccgtaccgtccttaccgtccacgccctaccgaaccgaccgggtcccacgtccgtcccgttccccgcgggccccgtcccgtcggccctaccgacgggacgtacccgacccgttaccgacgaccgccgaccgccggg

SEQ ID NO: 72082 - DNA, 575 bp, Homo sapiens
  misc_feature: GYAE6OF02IAX5X.21.26.C04.1.454.CMB.1.raw
  modified_base (523)..(523): a, c, t, g, unknown or other
  misc_feature (523)..(523): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggcccggagtggcttgcactcatttatggaatgatgataaccactacagccatctctgagaccaggctaccaccctcacgaaaggacaaccgaccaaaaaccaggtaggtacctaaacactcgaaccaacatacggaccccatcggacacacgccacatactactgtcacacgagggacgtggctagggtgtgggactacgtggggcccagggtacgtcgtaggcctaccgtctcctcacgcctaccaaccgacgggaccacgtcgtacccttccccgnggccctcccgtgacctccgacggacgccaccgtaccgacgacgaccacgcgg

SEQ ID NO: 72083 - DNA, 616 bp, Homo sapiens
  misc_feature: GYAE6OF02HXMBD.21.26.C04.1.454.CMB.1.raw
  modified_base (495)..(495): a, c, t, g, unknown or other
  misc_feature (495)..(495): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgagaccaggctcaccctcacgaacgacaaccgaccaaaaaaccaggtaggtacctaaacactacgaccaaacatcggaccccatacggacacagccacatactactagtcgacacgaacgggagtcggcgtggggtagtcgggaactacgtcgggggacccagggacgtccgtaggtccacgtcctccctnaaccgtcctcccaaccgaacgggcccacgttccggttacccttccccccgttaggcccgtaccccgtgtaccgtcccgacggacgccctacccgtccgaacggtacgccgaacgacccggg

SEQ ID NO: 72084 - DNA, 180 bp, Homo sapiens
  misc_feature: GYAE6OF02F5C2I.21.26.C04.1.454.CMB.1.raw
  modified_base (177)..(180): a, c, t, g, unknown or other
  misc_feature (177)..(180): n is a, c, g, or t
tcagtcgtcgctcgcacgaccggtgctcgatttagtctagcgactttgggttttggggggaagaggaagactgacggccctgctccaggagcacctccgagagcacagcggccctgggctgcctggtcaaggactacttccctcgtctctactgagcgggctggcaaggcgcatagnnnn

SEQ ID NO: 72085 - DNA, 577 bp, Homo sapiens
  misc_feature: GYAE6OF02FPBS4.21.26.C04.1.454.CMB.1.raw
  modified_base (349)..(349): a, c, t, g, unknown or other
  misc_feature (349)..(349): n is a, c, g, or t
  modified_base (421)..(421): a, c, t, g, unknown or other
  misc_feature (421)..(421): n is a, c, g, or t
  modified_base (527)..(527): a, c, t, g, unknown or other
  misc_feature (527)..(527): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctccaccctcacgaaggacacccgaccaaaaaccnggtcgtacctaaacacctagacccaaacactacggacccccagtcggacaacagcccaacactactactgtncacacgggagtggcgtgggtgtgggactacgtggggccgagggacgtccgtggtccaccgtctccgtcacgcctccacccgaacggcccagtccgtccttccccgnggcccgccctgcctccgacggacgccgaccgtccgagacgcgacgaccgg

SEQ ID NO: 72086 - DNA, 595 bp, Homo sapiens
  misc_feature: GYAE6OF02HESL9.21.26.C04.1.454.CMB.1.raw
  modified_base (358)..(358): a, c, t, g, unknown or other
  misc_feature (358)..(358): n is a, c, g, or t
  modified_base (570)..(570): a, c, t, g, unknown or other
  misc_feature (570)..(570): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgaataaccactacacgcccatctctggaggaccaggcctccaccctcgaacgaacggaccaccgaccaaaaaccgnggtacgtacctaaacactcgaaccaacactcggaaccccagtcggaacacacgccaacactactactgtcgacacgacgggagtggcgtggggtgtcgggactacgtcggggccagggcgtccgtggtccgaccgtctcctcgacgtccctaccaccgaacggcccaacgtccggttcccttccccgtggcccgtccctcgcctccgaggcnccgaccgtccgacgcgccacgccgg

SEQ ID NO: 72087 - DNA, 591 bp, Homo sapiens
  misc_feature: GYAE6OF02I3VC3.21.26.C04.1.454.CMB.1.raw
  modified_base (346)..(346): a, c, t, g, unknown or other
  misc_feature (346)..(346): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaagacaccgaccaaaaaccnggtcgtacctaaacactacgaaccaaacacgtcggacccccagtcggaacacacgcccaacactaactacgtgtcgacaacgacgggagtcggcgtgggtgtgggactacgtgggccgagggacgtccgtggtccacgtctccgtacacgcctccgaccgaacgggtcccagtccggtccttccccgtggcccgtccctcggcctaccgacggtacgccaaccgtccgacgacgccgaccgacgg

SEQ ID NO: 72088 - DNA, 699 bp, Homo sapiens
  misc_feature: GYAE6OF02IS708.21.26.C04.1.454.CMB.1.raw
  modified_base (355)..(355): a, c, t, g, unknown or other
  misc_feature (355)..(355): n is a, c, g, or t
tcagtcgtcgctcgcacgaccggtgctcgatttagtctagcgactttgggtttgggggaaggaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaagccccggagtggcttgcactcatttattggaatggatgataaccactacagcccatctctgacggaccaggcctcgaccctcaacgaacggccaaccgaccaaaaaaccgngggttaggtccctaaacgacgtacgaaccaaacagttccggaacccccagtcggaaccaacacgtacccacgaacttactactagtcgacaacgaccggggtagttcggcgttagggggtcgttaggggtacctacggttcggggcccgaaaggggtcgttccgtacggtaccgtaacccgttccgtacccgtcaacgtccccgtacccgaacccggaacgggtccccaagttcccgggttacccgtttcccccgtgggtccccgaccccgttcggtcccttaccccggaagggtaccgtcccgaacccttcccgggaacgtaacggtcccctaagacccgggg

SEQ ID NO: 72089 - DNA, 587 bp, Homo sapiens
  misc_feature: GYAE6OF02H4DQ8.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagcccatctctgaggaccaggctcaccctcacgaacgaccaccgaccaaaaaccaggtaggtacctaaacactacgaaccaacatacggaccccatacggacaacacgccacaatactactgtgcacgacgggagtggctgggtggtgggactacgtcggggaccaggggacgtcgtggtccaccgtcctccgtcgacgccctcccgaccgaacgggacccacgttccggtccttcccccgtggcccgccctcgcctccgaggcgccacccgtccgacgacgccgacgaccgg

SEQ ID NO: 72090 - DNA, 578 bp, Homo sapiens
  misc_feature: GYAE6OF02J17RI.21.26.C04.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagtctagcgactttgggtttggggggtaaggaggaaggactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggccccggagtggcttgcactcattatggaatgatgataaccactacagcccatctctgacggaccacggctccaccctcacgaacggtaccacccgaccaaaaaccgnggtcgtacctaacacgtcgaaccaacactcggaccccatggacaccagccaacactactactgtgcacgacgggagtggctggggtgtagggctacgtgggccgagggacgtcgtgccgaccgtcctacctcacgccctccaccgacgggacccacgtccggtccctccccgtggccgccctcgcctacccgagcgccgaccgtccgagcgcgaccgacggg

SEQ ID NO: 72091 - DNA, 636 bp, Homo sapiens
  misc_feature: GYAE6OF02HW5ZQ.21.26.C04.1.454.CMB.1.raw
  modified_base (216)..(216): a, c, t, g, unknown or other
  misc_feature (216)..(216): n is a, c, g, or t
  modified_base (264)..(264): a, c, t, g, unknown or other
  misc_feature (264)..(264): n is a, c, g, or t
  modified_base (340)..(340): a, c, t, g, unknown or other
  misc_feature (340)..(340): n is a, c, g, or t
  modified_base (396)..(396): a, c, t, g, unknown or other
  misc_feature (396)..(396): n is a, c, g, or t
tcagtcgtcgctcgcacgaccggtgctcgatttagtctagcgactttgggtttgggggtaaggaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtggngtggctgatcgtcagcccccggaagcccggagtggcttgcactcattntggatgatgactaacactacacgccatctctgagtaccaggctcaccctcacgaacggacaccgaccaaaaaccgnggtacggtcctaaacactacgaaccaacaatacggacccctagcggaaccacgacnccaacactactacgtgcgtacaacgacggagtggctaggggtcgtggggtacctacgggtgggccaaggggtacgtccgtgggtcccaaccggtcccttccgtccgacgtcccttaccgaaccgaacgggcccctaagtccggttacccttccccccggtggtcccgtccccttccggtccgtacccgtaacggtacccgcccgtaacccgtccggaccggacgaccccgagtaacccgg

SEQ ID NO: 72092 - DNA, 565 bp, Homo sapiens
  misc_feature: GYAE6OF02GE8GV.21.26.C04.1.454.CMB.1.raw
  modified_base (348)..(348): a, c, t, g, unknown or other
  misc_feature (348)..(348): n is a, c, g, or t
  modified_base (437)..(437): a, c, t, g, unknown or other
  misc_feature (437)..(437): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggtttttactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccnggtgtcctaacactgaccaacatcggaccccatggacacagccacatactactgtcgcacgacgggagtggctgggtgtgggactacgnggggccagggacgtccgtggtccaccgtctccgtcacgccctccaccgaacgggcccagtccggtccttccccgtggcccgcccgtgcctccgaggacgccacctccggacgacgccacgaggcccgg

SEQ ID NO: 72093 - DNA, 753 bp, Homo sapiens
  misc_feature: GYAE6OF02IIRNR.21.26.C04.1.454.CMB.1.raw
  modified_base (272)..(272): a, c, t, g, unknown or other
  misc_feature (272)..(272): n is a, c, g, or t
  modified_base (380)..(380): a, c, t, g, unknown or other
  misc_feature (380)..(380): n is a, c, g, or t
  modified_base (684)..(684): a, c, t, g, unknown or other
  misc_feature (684)..(684): n is a, c, g, or t
tcagtcgtcgctcgcacgaccggtgctcgatttagtctagcgactttgggtttggggggaaggaggaagactgacggtcctgctgctgaccatcccttcatgggtcttgtcccagatcaccttgaaggagtctggtcccacgctggtgaaacccacagagaccctcacgctgacctgcaccttctctgggtttttcactcagtaccactgcagtgggtgtgggctggatccgtcgacgcccccggaaaggccccgggagtcgggcttcgacnctcattttattggaatgatgataaccactacagcccatctctagacggaccagggcctaccgaccccttcaaccggaaacgggaccaaacccgacccaaaaaacccgnggttacgggtaccctaaacaccgtacggaacccaaactactaccgggaaccccctagtacgggtaccaacgaacgccctaacaactacctaagtacgtacaccgacgaagggcggtacggcggtacggggttgggacgggtaacgttacgggtaggggacccgtaggggtaaccgttccggttacgggtccctaacggttcccgtaccttaccgaccgtccctaaccccgtaccgggaaacccgggtaccctaaccggttcccggttccccgtttacccccgtgggtccccgtaccccggttcncccgggtacgtaccgggacccgtaccggtaccccgtaccggaccggtacgacccgaacgtaccccgggg

SEQ ID NO: 72094 - DNA, 660 bp, Homo sapiens
  misc_feature: GYAE6OF02JE6CK.21.26.C04.1.454.CMB.1.raw
  modified_base (321)..(321): a, c, t, g, unknown or other
  misc_feature (321)..(321): n is a, c, g, or t
  modified_base (333)..(333): a, c, t, g, unknown or other
  misc_feature (333)..(333): n is a, c, g, or t
  modified_base (386)..(386): a, c, t, g, unknown or other
  misc_feature (386)..(386): n is a, c, g, or t
tcagtcgtcgctcgcacgaccggtgctcgatttagtctagcgactttgggtttgggggaagagggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtcggcttgcactcatttacttggaattgatgataaccactacacgccactctcgtgacggtaccnggcctcaccctnaacgaagaccgacccgacaaaacctggtcgtacctaacacgtacgaaccaacncgtacgaccccatacggacacacgcccatactactacgtgtcgacaacgtacgggacgtacggcgtagggtacggtagggtaaccttgacggggacccaggggtacttccgtaggtacctacccggttctaccgtcgacgtcccgtaccgaccgaaaccggggtccctacggttcccggttcccttccccggcggtacccgtcccgttacgtcccggtaccgaacgggtaccgacccgtacccggtacccgaggtacccgccgtaccgtccggg

SEQ ID NO: 72095 - DNA, 610 bp, Homo sapiens
  misc_feature: GYAE6OF02FOVDE.21.26.C04.1.454.CMB.1.raw
  modified_base (357)..(357): a, c, t, g, unknown or other
  misc_feature (357)..(357): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggcctccaccctcacggaacggaccaaccgaccaaaaaccgngggtacgtacctaacactagaaccaaacactacggaaccccatcggaacaacacgccaacactactactgtcgacacgacgggagtggcgtgggtcgtgggactacggtcgggccgaggggacgtccgtggtcctaccgtctccgtcacgccctaccgaccgaacggccctacgtccgtccttccccgtcggcccgtcccgtcgcccgtccgacggaccgtcccaccgtaccgacggtacgccgacgtaccgg

SEQ ID NO: 72096 - DNA, 596 bp, Homo sapiens
  misc_feature: GYAE6OF02GQHKG.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccgnggtcgtcctaacactgaccaacatcggaccccatggacacacgccacatactactgtgacacgacgggagtggctgggtgtgggactacgtcgggccagggacgtccgtggtcaccgtctaccgtcgacgtccctaccgaccgaacgggcccctaagtcccggttccttccccccgtggccccgtccccgttcggccctaccgacgggacgtccgacccgtccggaacgacgtccgacgtacccggg

SEQ ID NO: 72097 - DNA, 635 bp, Homo sapiens
  misc_feature: GYAE6OF02JLY8H.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggccaggctcaccctcacgaacggacaccgaccaaaaaaccnggtacggtacccaacactgaacccaaacagtacggacccccatggaaccacagtcccaactatacctactcgtcgcacgaccgggagttgggcgtggggtcgtggggacttacggtggggcccaggggtaccgtccgtacggtcctacccgttccgtcccttccgacgtccctacccgaacccgaacggggcccctacgtccggttcccttcccccgttaggcccggtcccgtcgaccgtcccgacggacgacccgacccgtccggacggaccgaccaccgaccggg

SEQ ID NO: 72098 - DNA, 682 bp, Homo sapiens
  misc_feature: GYAE6OF02GXSKU.21.26.C04.1.454.CMB.1.raw
  modified_base (353)..(353): a, c, t, g, unknown or other
  misc_feature (353)..(353): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgacggaccaggctccaccctcaacgaacggaccaccgaccaaaaaccgnggtacggtacctaacactacgaaccaacatcggaccccagtacggacacacgaccacactactactgtacgacacgacgggtagtcggcgtggggtcgtacgggactacggtcggggaccgaggggtacgtccgtgggtaccgtacccggtcctacccgtcgaccgtcccgtacccgtaaccgaaaccgggtcccctaacgttcccgggttacccctttcccccggtaccgggtcccggtccccggttaccggccccgttacccggaacgggtacccgtacccgtaacccggtcccggtaacggaccggtacccgaaccgtacccgggg

SEQ ID NO: 72099 - DNA, 639 bp, Homo sapiens
  misc_feature: GYAE6OF02JSLSD.21.26.C04.1.454.CMB.1.raw
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (576)..(576): a, c, t, g, unknown or other
  misc_feature (576)..(576): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttatggaatgatgataaccactacacgcccatctctgacggaccaggcctccgaccctcgaacggaagaccacccgaccaaaaaccgnggtcggtacctaacactcgaaccaanacgtcggaaccccagtcggaacacgacgccaactactaccgtactagtcacaacgacgggagtcgggcgtacggggtgtacgggaccttacggcggggaccgagggacgttcctgggtccctaacgttcctccgttcgaacgtcccgtacccgaaccgaacgggccctaagttcccggtaccctttcccccgngggccctaccccgtgaccctccggacggacgccctaccgccgtacgacgtcccaactccgggg

SEQ ID NO: 72100 - DNA, 586 bp, Homo sapiens
  misc_feature: GYAE6OF02JA57C.21.26.C04.1.454.CMB.1.raw
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgaataaccactacacgccatctctgacggaccaggctcacccncacgaaggacaccgacaaaaccnggtcgtacctaacactgaaccaacactacggaccccatcggaacacacgaccaacactaactactgtacgcaacgacgggagtggcgtggggtcgtgggactacggtcggggccgaggggactccgtcggcctaccgtctcctacacgtccgtccaccgtaagggccccaagtcccggtccttccccgcggccgccctcgctccgacggacgccacctcggacggacgaccacgacgg

SEQ ID NO: 72101 - DNA, 579 bp, Homo sapiens
  misc_feature: GYAE6OF02GJPCD.21.26.C04.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccaggctcaccctcacgaaggacaccgaccaaaaaccnggtcggtcctaacactgaccaacatcggaccccatcggacacagccacatactactgtgcacgacgggagtgggctggggtgtgggactacggtggggcccaggggtacgtccgtggtccaccgttctcccgtcacgtccctccgaaccgaacgggccccagtcccggtccttcccccgtggcccgtccctcggcctccgaggacgccaccgtccgagacgcacaccggg

SEQ ID NO: 72102 - DNA, 715 bp, Homo sapiens
  misc_feature: GYAE6OF02G3V7W.21.26.C04.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcattttattggaatgatgataaccactacagcccatctctgaggaccaggcctcaccctcacgaaaggaccaacccgaccaaaaaccnggtacggtacctaacacctcgaacccaaacacttacgggaaccccctagtacggaaccacaacgacccaacactacctactgtacgccacgtacgggaggttcgggcgttggggtggtacgggaccgttacggtgggggacccgaaggggtacgttcccgttcggtccgtaacccggttctacccgtcgaccgaccctccccgtaacccgaaccgggtccccctaacggttccccgggttacccgtttccccccgttcgggtacccccggtcccccgttcggaccccttacccggaacgggtaccgtcccgtaaccccggtacccgtaaccgggaacccgtcccgaacccgacccgggg

SEQ ID NO: 72103 - DNA, 603 bp, Homo sapiens
  misc_feature: GYAE6OF02JM00Q.21.26.C04.1.454.CMB.1.raw
  modified_base (360)..(360): a, c, t, g, unknown or other
  misc_feature (360)..(360): n is a, c, g, or t
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagtcgtcgctcgcacgaccggtgctcgatttagtctagcgactttgggtttggggggtaaggaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtcggcttgcactcatttattggaatgatgaataaccatacagcccatctctgacggaccaggcctcaccctcaacggaacggaccaccgaccaaaaacccgnggtcggtacctaacactacgaaccaacatacggaccccagtcggacacacgccanatctactgncacgacgggngtggcgtgggngtacgggactacgtggggaccagggacgtccgtggtccgacccgtctccgtaccgacgtccctaccgacccgaacgggccctagttcccgtccttacccccgtggcccgtcccgtcgctcccggaggtacgccacccgtcggacgcgtccacgtccgg

SEQ ID NO: 72104 - DNA, 621 bp, Homo sapiens
  misc_feature: GYAE6OF02HSVKJ.21.26.C04.1.454.CMB.1.raw
  modified_base (354)..(354): a, c, t, g, unknown or other
  misc_feature (354)..(354): n is a, c, g, or t
  modified_base (420)..(420): a, c, t, g, unknown or other
  misc_feature (420)..(420): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtggactggatccgtcacgccccccggaaaggcccggagtggcttgcactctatttatggaatgatgataaccactacagcccatctctgaaggaccaggctcaccctcacgaacggaccaccgaaccaaaaaccgnggtacggtacctaaacgactcgaaccaacagtcggaccccagtacggacacagaccacatacatgngacacgacgggagtggcgtgggtggtagggtactacggtcggggaccgagggtacgtccgtcggtccaccgtcctccgtaccgacgccctacccgaaccgaaccgggccctacgtcccggtaccttcccccggtggtcccgcccgtcgccgtaccgtaggaccgccgtacccgtccggaacggacgtaccgacgtaccggg

SEQ ID NO: 72105 - DNA, 178 bp, Homo sapiens
  misc_feature: GYAE6OF02GWNE4.21.26.C04.1.454.CMB.1.raw
  modified_base (177)..(178): a, c, t, g, unknown or other
  misc_feature (177)..(178): n is a, c, g, or t
tcagtcgtcgctcgcacgaccggtgctcgatttagtctagcgactttgggttttggggggaagaggaagactgacggccctgctccaggagcacctccgagagcacagcggccctgggctgcctggtcaaggactacttccctcgtctctactgagcgggctggcaaggcgcatagnn

SEQ ID NO: 72106 - DNA, 611 bp, Homo sapiens
  misc_feature: GYAE6OF02H50R3.21.26.C04.1.454.CMB.1.raw
  modified_base (355)..(355): a, c, t, g, unknown or other
  misc_feature (355)..(355): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgactaaccactacagcccatctctgaggaccaggcctcaccctcaacgaacggacaccgaccaaaaaccgnggtcgtacctaacactacgaccaaacactacggaccccatacggacacacgccaacactactaacgtgtcgacacgacgggagtggctgggtgtgggactacggtggggaccagggcgtccgtggtaccgccgtctccctcgacgtcctacccgaaccgtaacgggccctaagtccggttcccgttccccgtcggacccgtcccgtcgcccgtaccgacggacgccctaccgtccgacggacggaccacgaccggg

SEQ ID NO: 72107 - DNA, 596 bp, Homo sapiens
  misc_feature: GYAE6OF02HDZII.21.26.C04.1.454.CMB.1.raw
  modified_base (352)..(352): a, c, t, g, unknown or other
  misc_feature (352)..(352): n is a, c, g, or t
  modified_base (487)..(487): a, c, t, g, unknown or other
  misc_feature (487)..(487): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgacggaccaggctccaccctcaacgaaggaccaccgaccaaaaaccnggtcggtacctaacactgaccaacactcggaaccccatcggacacagccacatactactgtcgacacgacgggagtggcgtgggtggtagggactacggtcgggaccgagggacgtccgtggtccaccgtctccncgacgcctaccgaccgaacggcccagtccgtccttccccgtcggcccgtccctcgtacccgtccgacggaccgaccgtacccgtccgacggacggaccaccggtaccgg

SEQ ID NO: 72108 - DNA, 696 bp, Homo sapiens
  misc_feature: GYAE6OF02IK46K.21.26.C04.1.454.CMB.1.raw
  modified_base (317)..(317): a, c, t, g, unknown or other
  misc_feature (317)..(317): n is a, c, g, or t
  modified_base (351)..(351): a, c, t, g, unknown or other
  misc_feature (351)..(351): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggcccggagtggcttgcactcatttattggaatgatgataaccactacagcccatctctgaggaccaggcncaccctcacgaacggaccaccgaccaaaaaccgnggtacggtacctaacactacgaaccaacacgtacggaaccccaagtacggacaaccacgaccaaccaacgtacctaacgtcgtacgaccgaacggacggggtacgtcggaccgttgggggtacggtacggggtacctaacgggttcggggaccgtaacggggtacggttcccgtagggccctaccgggttcctacccgtaccgacgcccgtccgaaacccgtaaccgggtcccctacgttacccgggtccctttacccccggtaggtccccggtccccttacggcccttacccggaacggaccgccctaacccggaccggaacggaccgaccgtacgacccgggg

SEQ ID NO: 72109 - DNA, 675 bp, Homo sapiens
  misc_feature: GYAE6OF02I17NY.21.26.C04.1.454.CMB.1.raw
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
  modified_base (472)..(472): a, c, t, g, unknown or other
  misc_feature (472)..(472): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatcgatgataaccacgtacagcccagtctctgaggaccaggctcaccctcacgaacggacaccgaccaaaaaccnggtcgtacctaacnctagaccaacatcggaccccatcggaacacgacgcccaacactaacctactcgtacgccaacgaacggggacgtggccgtggggtacggtcgggaccttaacggnggggacccgaggggtacgtccgtgggtaccaccggtctacccgttcacgtccctaccgaacccgtaacgggccccctaagtcccgggttaccctttacccccggtcgggtaccccggcccccgtttacggcccgtttcccgaacgggtaccgtacccgtaccccggttacccggacggaccggtacccgtaccgtacccgggg

SEQ ID NO: 72110 - DNA, 636 bp, Homo sapiens
  misc_feature: GYAE6OF02JBZ0B.21.26.C04.1.454.CMB.1.raw
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacggctggtcgaaacccacagacgaccctcacgctgacctgcaccttctctggttttcactcagtaccactgcagtgggtgtggctggactccgtcacgcccccggaaaggcccggagtggcttgcactcatttatacggaatgatgactaaccactacagccatcttcagacgacaggctcacctnacgagacaccgacaaaacgngtcgacctacactgaccaanactacggacccagtcgacacacgccactactactactgtacacacgacgggtagtggactagggtgtacggacttacggcgggtaccgaagggtactccggtaggtaccggtaccgttccgttcccgacgtaccgccctaccgaaaccggaccgggtccctaacgtccgtacccgttccccgtagggtccccgtaaccccgttggcccttaaccgggaccggtacgaccccgtacccgttaccggaagacccggaccgtaaccgcccgggg

SEQ ID NO: 72111 - DNA, 583 bp, Homo sapiens
  misc_feature: GYAE6OF02GCMA4.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttatggaatgatgataaccactacagcccatctctgaggaccaggctcaccctcacgaaggacaccgaccaaaaaccnggtgtacctaacactgaaccaacatacggacccccatcggaccacgagcccacatacctactgtcgcacgacgggagtggcgtgggtgtgggactacgtcggggccagggctccgtggtcaccgtcctccgtcacgccctaccgaccgaacgggcccagtccggtccttcccccgtggcccgcccgtcgcctcccgacggtacgccgtacccgtccggacgtacgccaccgacggg

SEQ ID NO: 72112 - DNA, 579 bp, Homo sapiens
  misc_feature: GYAE6OF02FKIIT.21.26.C04.1.454.CMB.1.raw
  modified_base (349)..(349): a, c, t, g, unknown or other
  misc_feature (349)..(349): n is a, c, g, or t
  modified_base (402)..(402): a, c, t, g, unknown or other
  misc_feature (402)..(402): n is a, c, g, or t
  modified_base (553)..(553): a, c, t, g, unknown or other
  misc_feature (553)..(553): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccccggaaaggccccggagtggcttgcactcatttatggaatgatgataaccactacagcccatctctgaggaccaggctcaccctcacgaacggacaccgaccaaaaaccnggtcggtcctaacactgaaccaacactcggaccccagtcggacacacgcccanactactactgtcgcacgacgggagtggcgtgggtgtgggactacgtggggccagggcgtcctggtccaccgttctcctcgacgccctaccaccgaacggcccagtcccggtccttcccccgtcggcccgtccctcgccgtaccgaggtacnccacccgtccgacgacgccacgccgg

SEQ ID NO: 72113 - DNA, 705 bp, Homo sapiens
  misc_feature: GYAE6OF02IS5WH.21.26.C04.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcaccggccccccggaaaggccccggagtggcttgcactctatttattggaatgatgaactaaccactacacgcccatctctgaggaccaggctccaccctcacgaaggaccacccgaccaaaaccgnggtcggtacctaacactcgaaccaaacataccggaccccagtacggacaacgacgacccaactaacttacctactgtacgaccgaacgacggggagtgggtcgtggggtcggtacgggacgtacggtcggggccgacggggtacgttcccgtaggtccgtaccgtccgttcctaccggaccgtcccgtaacccgaaccgtaaccggggtcccctaacggtttcccgggttaccccgtttcccccggtaccgggccccgttccccggttaccggccccgttacccggaccgggtaacccgcccaacccggttcccggaacgtaaccggcccgaaccggtaccccgggg

SEQ ID NO: 72114 - DNA, 578 bp, Homo sapiens
  misc_feature: GYAE6OF02GTCQK.21.26.C04.1.454.CMB.1.raw
  modified_base (348)..(348): a, c, t, g, unknown or other
  misc_feature (348)..(348): n is a, c, g, or t
  modified_base (410)..(410): a, c, t, g, unknown or other
  misc_feature (410)..(410): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggacaccgaccaaaaaccnggtgtacctaacactgaaccaacactacggaccccatcggacacagccacatactactgtcncacgacgggagtggcgtgggtgtgggactacgtggggccgagggacgtccgtggtccaccgtctcccgtcgacgtccctaccaccgaacgggccccagtccggtccttcccccgtggcccgtcccgtcgcctccgacggtcgaccacccgtccgagacgccacgccgg

SEQ ID NO: 72115 - DNA, 669 bp, Homo sapiens
  misc_feature: GYAE6OF02F1UFX.21.26.C04.1.454.CMB.1.raw
  modified_base (590)..(590): a, c, t, g, unknown or other
  misc_feature (590)..(590): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgacggaccaggcctccaccctcaacgaacggaccacccgaaccaaaaccgaggtcggtacctaacactacgaccaacatcggaccccagtacggacacgacgccaacactactacgtcgtcgaccacggacgggtaggtcggcgttggggtacggtcggggtacttaccgggtgggggacccgtaggggtaaccgtccgttacgggtccaacccggttcctacccgtcgacgtcccgtacccaaccggaacggcccctacggttcccggtccctttcccccggngggcccgtccccgtgtccccgtacccggaggtacccgccgtaccccggtcccggaacggtccgccgtaaccgacccggg

SEQ ID NO: 72116 - DNA, 632 bp, Homo sapiens
  misc_feature: GYAE6OF02HUPWG.21.26.C04.1.454.CMB.1.raw
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (440)..(440): a, c, t, g, unknown or other
  misc_feature (440)..(440): n is a, c, g, or t
  modified_base (454)..(454): a, c, t, g, unknown or other
  misc_feature (454)..(454): n is a, c, g, or t
tcagtcgtcgctcgcacgaccggtgctcgatttagtctagcgacttgggtttgggggaagaggaaggactgacggtcctgctgctgaccatcccttcatgggtcttgtcccacgatcaccttgaacggaggtctggtcccacgctggtgaacccacagagaccctcacgctgacctgcaccttctctgggttttcactccacgtaccactgcagtgggtgtgggctggatccgtcacgcccccggaaaggccccggagtcggcttcgctacgtctatttattggaatgactgtaataaccactacagccatacncgtagacgaccaggtctccacctcacgacggacaccgacaaaacgngtaggtacctaacgactcgaaccanataccggaccccagtcggacaacgtacgaccacgactactactgtcacctaacgnggacgtgcgtgggngtacgggactacgtggggaccaagggtcgtccgtggacctacgtcctccgtcgacgccctccgaaccgtacgggccctaaccgtcggttacccttcccggtacggtcccggtcccgtacggtccacccggtacggacgtaccctccggaccggtaacgacgtcccgaacgtacccggg

SEQ ID NO: 72117 - DNA, 592 bp, Homo sapiens
  misc_feature: GYAE6OF02FYZQQ.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggacaccgaccaaaaaccnggtgtacctaacactcgaaccaacatcggaccccatcggacacacgccacactactactgtcgcacgacggggagtggctggggtgtcgggactacgtggggaccaggggctcccgtggtccaccgttctcccgtcacgccctaccgaaccgaacgggccccagttcccggtccttcccccgtggcccgtcccgtcgccctcccgaaggcgcccgtaccctcccggagaccgccacgtaccggg

SEQ ID NO: 72118 - DNA, 562 bp, Homo sapiens
  misc_feature: GYAE6OF02HNTLW.21.26.C04.1.454.CMB.1.raw
  modified_base (511)..(511): a, c, t, g, unknown or other
  misc_feature (511)..(511): n is a, c, g, or t
  modified_base (537)..(537): a, c, t, g, unknown or other
  misc_feature (537)..(537): n is a, c, g, or t
  modified_base (552)..(552): a, c, t, g, unknown or other
  misc_feature (552)..(552): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgccaaaaaccaggtggtcctaacactgaccaacatggaccccatggacacagccacatactactgtgcacacgggagtggctgggtgtgggactacgtggggccaggggagtccgtggtccaccgtctccgtcacgcctccacccgaacgggccccagttccggtccttcccccgnggtcccgccctcgcctcccgaggacnccaccgtccgagacncgaccgacgg

SEQ ID NO: 72119 - DNA, 652 bp, Homo sapiens
  misc_feature: GYAE6OF02G3LP5.21.26.C04.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacgcccccggaaaggccccggagtggcttgcactcatttatggaatgatgataaccactacagcccatctctgacggaccaggctcaccctcacgacgaccaccgaccaaaaccgnggtcgtacctaacacctagaacccaacactaccggaccccagtacggaaccacaacgccaacactaacctactagtcgacacgacgggagtcggcgtggggtgtacgggtactacggtcggggccgaagggtccgttccgtcgggtaccacccggttcctcctacgacgcccgttaccgaacccgaacgggtcccctaagttcccgggttacccctttcccccggtcggtccccggtccccgtcggtacccgtccggaacggaccgtcccgtaccgttcccggacggacgcccgtacgacccggg

SEQ ID NO: 72120 - DNA, 791 bp, Homo sapiens
  misc_feature: GYAE6OF02GZMTQ.21.26.C04.1.454.CMB.1.raw
tcagtcgtcgctcgcacgaccggtgctcgatttagtctagcgactttgggtttgggggaaggaggaaggactgaccggttccgttggctgcgttgaccatcccgttcagtgggtcttgtcccagatcaccttagaaggagtctggtcccagtcgtggtagaaacccacagagaccctacacgctggacctgcaccttcgtcgttggggttttcactcacgttaccgtactgtcaggttgggttaggtgggtcgtcggagttccggtcgacggaccccccgggaaagggccccgggtaggtcgggcgttcggccggacgtcgtagttttacgttagggaacttggagtcgtaactaaccgaactacacgtccctattcgtctaggacggacccgaggtcctacctaccctacaacgtaacggaaccaacccgaccgaaaaaccgtagggtacggtaccctaacgaccgtacgaaccaacgacgtacgggaccccagtacggacacgacgaccgaactaactaccgtactggtacgacgaacgtaacgggtacgttagggccgtaggggttacggtacgggtaccgtaccggtacggggacccgtaagggtaccgttccggtacggtacccgtaaccggtttcctaccgtacgtaccgtccctaccgaaccgtaacgggaccctaacggttacccggtacccttacccccgtcgggtacccgtcccgttacgacccgttaccgaacggtacgacccgtacccggtccgaacggtacgaccgtacggacccggg

SEQ ID NO: 72121 - DNA, 656 bp, Homo sapiens
  misc_feature: GYAE6OF02IZ93P.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtacactgcagtgggtgtgggctggatccgtcacgcccccggaaaggccccggagtggcttgcactcatttattggaatgatgaactaaaccactacacacccatctctgacggaccaggctccaccctcacggaacggacaacccgaaccaaaaaccgaggtcgtacctaacactacgaccaacactacggaccccagtcggaacacagaccacataactactgcgcacgacgggaacggtcggcgttggggtcgtacgggtacgtacggtcggggccgtaggggacgttcccgcggttccgtacccgtcctacccgttcgaccgtccctacccgaccgtaaccgggcccgtaacgtcccgggttacccgttcccccggtggtccccgtcccgtccggaccgtacccggacggaccgccgtacccgtaccggtacggacgtaccgaacgtcccggg

SEQ ID NO: 72122 - DNA, 689 bp, Homo sapiens
  misc_feature: GYAE6OF02GJWG7.21.26.C04.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggccccggagtggcttgcactctatttagttggaatgatgataaccactacagcccatctctgagaccagctcaccctcacgaacggacaccgaacaaaaccgnggtacgtacctaacactacgaaccaacacgtcggaaccccagtacggaaccacacgacccaacacttacctacgtgtacgacgtaccgaccggggtagtcgggtcgtgggggtacggtcgggaaccgtacggtcgggggaccgaggggtacgtccgttcggtccgaccggttccgtccgtacgaccgtccctacccgaaccggtaaccgggacccctacggttccccggttccctttcccccgggtacggtccccgtaccccgtccggtaccccgtacccggacggtaccgtacccgtacccggttacccggaacggacgacccgtaacccgtacccgggg

SEQ ID NO: 72123 - DNA, 607 bp, Homo sapiens
  misc_feature: GYAE6OF02F9DFE.21.26.C04.1.454.CMB.1.raw
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
tcagtcgtcgctcgcacgaccggtgctcgatttagtctagcgacttgggtttgggggaagaggaagactgacggtcctgctgctgaccatcccttcatgggtcttgtcccagatcacccttgaaggagtctggtccccacgctggtgaaacccacagagaccctcacgctgacctgcaccttctctgggtttcactcagtaccactgcagtggtgtgggctggatccgtcagccccccggaaaggcccccggagtggcttgccactcatttatggaaatgattgacttaaccactacagccccatctctgaggaccaggtctcaccctnacgaagccaccgccaaaaccnggtacgcctaacnctgaccaacntacgggaccccagtcggacacagcccaacgattaccactgtcgacgacgaaccgggtagtcggcctggggttcgtcgggaactcggtcgggccgagggtacgtccgtggtccacccgtctccctcgacgccctccgaaccgaacggcccagttcccggtccttacccccgtggcccgccccgtggaccctccgaggaccgtcaccccgttccggacgtacgccaaccgtccggg

SEQ ID NO: 72124 - DNA, 634 bp, Homo sapiens
  misc_feature: GYAE6OF02IHUES.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaacggccccggagtcggcttgcactcatttattggaatgatgataaccactacagccatctctgaggaccaggcctcaccctcacgaacggaccaaccgaccaaaaaccgaggtcggtacctaacactacgaccaacatacgacccatacggacacacgccacatactactgtcgacacgacgggagtggcgtggggtgtacgggtacgtacggtcggggaccgaggggtacgtccgtggtccaccgttctcctcgacgtcccgtaccgaccgaaccgggccctacgttcccggtccctttcccccgtcgggcccgtccccgtccgtcccgtacccgacggaccgtacccgtacccgtaccggacggtacgacccgaccggtacccggg

SEQ ID NO: 72125 - DNA, 809 bp, Homo sapiens
  misc_feature: GYAE6OF02IXSCD.21.26.C04.1.454.CMB.1.raw
tcagtcgtcgctcgcacgaccggtgctcgatttagtctagcgactttgggtttgggggggaagagggaagactgacggtcctgctgctgaccatcccttcatgggtcttgtcccagatcaccttgaaggagtcgtggtcccacgctgggtgaaacccacagagaccctcacgctggacctgcaccttctctgggtttcactcacgtaccactgcaggtgggtcgtcgggctggactccgtcacgcccccggaaaggccccggagtcggcttgcgactcatttactggaatcgatgataaccactaacacgaccaatctacttggacggtaccaggcctacaccctacgacggaaacggacccaccgaaccaaaaaccgtcgggtacggtacccttaaacgaccgttacgaaaccctaaacgtacgttaccgggtaaccccagtcgggaaccaacgacggtacccaactaacttacgtacgtacggtacggaccgaacggaacggggagtcggtcgtaggggttcgtaacgggtaactaacggtcggggacccgtaacggggtacgtccgtacgggtaccgtaacccggttcgttacccggtacgaaccgggttaccccttacccggtaaacccggtaaccgggggtaccccttaacggttacccgggtttaccccgtttacccccggttcgggtacccggttccccgtttacgggtccccggtttaacccggtaccggggtaacccggtacccggtaaccccgttacccgggaacggtaaccggtacccggtaacccgtaacccggggg

SEQ ID NO: 72126 - DNA, 688 bp, Homo sapiens
  misc_feature: GYAE6OF02GAYOK.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggctgcactcatttatggaatgatgaataaccactacacgcccatctctagacggaccaggcctaccgaccctcgaacggaaacggaccaacccgacccaaaaaccgcggtacggtaccctaaacaccgtacgaacccaacaacgtcggaaccccagtaggaaccacgacgacccaacgtactaactactgtacaccgacgacggggactggtcgtagggtcggtaggtaccgtacggtgggaccgaggggtaacctccggtcggtaccgtacccgttcgtacccgttccgacgtccctacccgaaccgtaacgggccccttagtaccggttcccctttccccgcggtcccgtccccgttaccggcccttacccgaagggtaccgaccccgtaacccggtcccggaacgacccgtaccgaaccggtcccggg

SEQ ID NO: 72127 - DNA, 704 bp, Homo sapiens
  misc_feature: GYAE6OF02J22IT.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacacgcccatctctgacggaccacggtctccaccctacaaccggaacggaccaacccgaaccaaaaaccgacggtcggtacctaacgactgaaccctaacactacggaccccatcggaacaccagcccacacgtactactacgtcgacctacgacgggtaacgtggacgtggggtcgtcgggacttacgtcgggggtaccgaggggtaccggttccgtcgggtacctaacccggtctacccgtacggaccgtcccgtacccgaacccggaaaccgggtcccgaaccgttcccggggttacccttccccccgtggggtccccgtcccccggttggaacccgtccccgaacgggtaccgtaccccgtaaccccggttacccgggaacggtccggtaccgaccggtaaccccgggg

SEQ ID NO: 72128 - DNA, 704 bp, Homo sapiens
  misc_feature: GYAE6OF02JBDZ8.21.26.C04.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcgagtgggtgtgggctggatccgtcacggaccccccggaaaggccccggagtcggcttcgcactctatttatggaatgatcgataaccactacacgcccatcctntagacggaccgaggcctccaccctacacgaacggaccaacccgaaccaaaaaccgtaggtaccggtacctaacacctacgaaccaacgtacgaccggtaaccccaagtcggaaccaacgaacgacccgaaactaacgtttaccgtactcggacgtaaccgacgtaacgggtagtcgggtaccgtgggtcgggttagggaacctcgggtacgggaccgtaaggggtaccgtacccggtggacccgttacccgtccgtaccctccgaccgtcccgtacccgaaccgaaccgggtcccgtaactccgtttcccgtccccgtacggacccgtcccggtcgaccaccggtaccggcgtacccgacccgttccggacgtaccggacctacggacccgg

SEQ ID NO: 72129 - DNA, 181 bp, Homo sapiens
  misc_feature: GYAE6OF02GNCLP.21.26.C04.1.454.CMB.1.raw
  modified_base (175)..(181): a, c, t, g, unknown or other
  misc_feature (175)..(181): n is a, c, g, or t
tcagtcgtcgctcgcacgaccggtgctcgatttagtctagcgactttgggtttgggggaagaggaagactgacggccctgctccaggagcacctccgagagcacagcggccctgggctgcctggtcaaggactacttccctcgtctctactgagcgggctggcaaggcgcatagnnnnnnn

SEQ ID NO: 72130 - DNA, 719 bp, Homo sapiens
  misc_feature: GYAE6OF02IS7MJ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaacggccccggagtcggcttgcactctattttacttggaatggatgaactaaccactacagcccatctctgacggtaccaggcctaccacccgtacaacgaaacggaccaaccgaaccaaaaaccgaggttacggtacctaaacactcgaaacctaacagtaccgaccccacgtacggacctacgacgaccaaacgtacgtaactaacgtacgtcgacgaccgaaccgggtaaggtcgggtaacgttggggttacgtacgggtacgtaccggtcgggtacccggagggttaaccggtccgtcggtaccgtaaccggtcctaccgttcgaccgtacccgttacccgaaccgtaaccgggccctaacggttcccgttaccccgttccccggtggtaccccgtacccgtacggtccctaaccggaacggtccgaacccgtacccgttacccgacggtacggaccctaacggacccggg

SEQ ID NO: 72131 - DNA, 784 bp, Homo sapiens
  misc_feature: GYAE6OF02F8WB7.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaaccccacagacgaccctcacgctcgacctgcctaccttctcgttgggttttcactcagtaccactgcaggtgggtggtgggctggactccgtcaccggacccccgggaaacgggccccggaggtcggtcttgacctactctattttagttggaatggtatgtaactaaccactaacacgcccctaatctctaggaacgggaaccgaggcctaccgaccctacgaacggaacggacccaacccgaaaccaaaaacccggaggttaccggtacctaaacctacgtacgaaacccaaacaacgtaccggaaccccagtacggaactaaccacgaccaacgactaacctaactcggtacgaccgtaaaccggacgggggtaaggtcgggaccggttagggggtacgggtacgggggtaaccttacggggtccggggggacctaacgggggtacgttcccggtgggttacccgtaaccgggttccttaacccggtccgaccgtaccccttacccgaaaccggaaccgggtcccctaaccggttcccgggtccccgttaccccgtcgggccccgtaacccgtcgtacccgttccggacgaccgtaccgaccccgttcggaccgacgtccaacggtcccggg

SEQ ID NO: 72132 - DNA, 717 bp, Homo sapiens
  misc_feature: GYAE6OF02HATQ4.21.26.C04.1.454.CMB.1.raw
  modified_base (357)..(357): a, c, t, g, unknown or other
  misc_feature (357)..(357): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcaggtgggtgtgggctggatccgtcacgcccccggaaggccccggagtcgcttgcactcatttagtggaatgatgaactaaccactacacgcccatctctggacggaccaggcctcaccctcgacgaaggaccaaccgaccaaaaccgngtacggtacctaacactacgaaccaaacacgtaccggaacccctagtcggaaccacgaacgaccaacctaactaaccttacgtgtacgacaacggacgggtaggtgggacgtggggtggtacgggactccgggtcggggacccgaggggtaccggttaccgtgggtacccacccggttctaccccttcgaccgtaccccgtacccgaacccggtaacggggtcccctaacggttccccgggttcccccgttaccccggtcggggtacccccgtccccgttacggtcccgtacccggaaccgggtaccgcccggtaacccgtacccgggtaacggacccggtacccgaaccggtacccggg

SEQ ID NO: 72133 - DNA, 642 bp, Homo sapiens
  misc_feature: GYAE6OF02F98BE.21.26.C04.1.454.CMB.1.raw
  modified_base (355)..(355): a, c, t, g, unknown or other
  misc_feature (355)..(355): n is a, c, g, or t
  modified_base (530)..(530): a, c, t, g, unknown or other
  misc_feature (530)..(530): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttatggaatgatgataaccactacagcccatctctgaggaccaggcctcaccctcacgaacggaccaacccgaccaaaaaccgnggtacggtacctaacactacgaaccctaaacacgtaccggacccctagtacggaaccaaccgacgacccaacgtaactacctactagtacgaccacgaacggggagtgggtacgtggggtcggtacgggacctacggtcggggaccgaggggaccgtcgtcggtccaccgttccncctcgacgccctaccgaaccggaacggccctagtccggttcccttccccgcggcccgcccgtcgccgtaccgaggaccgtccgaccgtccggacgacgccgaccgtaccggg

SEQ ID NO: 72134 - DNA, 568 bp, Homo sapiens
  misc_feature: GYAE6OF02HTI2A.21.26.C04.1.454.CMB.1.raw
  modified_base (349)..(349): a, c, t, g, unknown or other
  misc_feature (349)..(349): n is a, c, g, or t
  modified_base (434)..(434): a, c, t, g, unknown or other
  misc_feature (434)..(434): n is a, c, g, or t
  modified_base (489)..(489): a, c, t, g, unknown or other
  misc_feature (489)..(489): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgacggaccaggctcaccctcacgaaggacaccgaccaaaaacnggtgtaccctaacactcgaaccaacactcggaaccccatcggaacaccagccaacataactactgtcgcaacgacgggagtcggntgggtggtagggacctacgtggggccaggggtagtccgtggtccaccgtcctccncagcctaccaccgaacgggccagtccgtccttccccgtggccgccctcgcctccgagcgcacctccgagacgcacacgg

SEQ ID NO: 72135 - DNA, 656 bp, Homo sapiens
  misc_feature: GYAE6OF02JP2V9.21.26.C04.1.454.CMB.1.raw
  modified_base (319)..(319): a, c, t, g, unknown or other
  misc_feature (319)..(319): n is a, c, g, or t
  modified_base (414)..(414): a, c, t, g, unknown or other
  misc_feature (414)..(414): n is a, c, g, or t
tcagtcgtcgctcgcacgaccggtgctcgatttagtctagcgactttgggtttggggggtaaggagggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagttgggtgtgggctggatcccgtcaccgccccccggaaaggccccggagtggtccttggcctactcatttagttggaatgtatagtacttaaaccataccacaccgntcctatgacggccaacggctcgtaccctacgaccgaaggaccctaaccaaccaaacccgtaaggtcggttacctaaaccgctaccgaacaaaccncgtaccgaacccagtacgaccaccacgaccgacgttacaccttaacggacgttacgaccgtaccgtacggacggtacgtacgtacggtacggtacggtacggtacggtacggtacggtacggtacgtacgtacggtaccgtcgtcgtaccgtcaccgtccgtccgaccgacgtaccgtaccgtcgtccgtaccgtccgcgccgtccgtcgtcgcgacgtaccgaccgacgacgacgcgcgcg

SEQ ID NO: 72136 - DNA, 596 bp, Homo sapiens
  misc_feature: GYAE6OF02FSE2P.21.26.C04.1.454.CMB.1.raw
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
  modified_base (550)..(550): a, c, t, g, unknown or other
  misc_feature (550)..(550): n is a, c, g, or t
  modified_base (558)..(558): a, c, t, g, unknown or other
  misc_feature (558)..(558): n is a, c, g, or t
  modified_base (584)..(584): a, c, t, g, unknown or other
  misc_feature (584)..(584): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacgccccccggaaaggccccggagtggcttgcactcatttatggaatgatgataaccactacacgcccatctctgacggaccaggcctccaccctacgaaccggaacggaccaacccgaacccaaaaaaccgtggtacggtacctaacactacgaaacccaacataccggaaccccatacggaacacacgaccaacactactactgtcgacacgacgggagtggcgtggggtgtgggactcggtcggggccgagggctccgtggtccnccgtctccncaccgcctaccgacgacggcccacgtccgtcccttcccgngccgtccncgcctccgagacgccaccgtccggancgccacgaccgg

SEQ ID NO: 72137 - DNA, 684 bp, Homo sapiens
  misc_feature: GYAE6OF02JLA25.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcacgccccccggaaaggccccggagtggcgttgcactcgatttatggaatgatgataaccactacacgccatctctgacggaccaggcctccaccctcgaacgaacgaccgaccgaccaaaaactggtacgtacctaacactacgaaccaacgtacgtaccggaaccccagtacggacaaccgacgacccgaactactaacctactcgtacgacctaacggaccgggtagtcgggtcgtaggggtcgtacgggacttaacgggtcgggtaccgaggggtaccgtccggtacggtaccgtacccgttcgtcccgtagtaccgacccgttacccgaacccgtaaccgggcccgtaaccggtccggttaccccgttccccggtcggaccctccccggtacgccccgtaccgacggacgtcccgacctaccggacgttaccgccgtaccggaccgg

SEQ ID NO: 72138 - DNA, 660 bp, Homo sapiens
  misc_feature: GYAE6OF02G4KSB.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcaccggaccccccggaaacggccccggagtcggcttgcactcatttatggaatgatgataaccactacagcccatctctgaggaccaggcctcaccctcgacgaaggaccacccgaaccaaaaaccgaggtcgtacctaacactacgaacccaaacagtaccggaccccagtacggaaccacaacgcccaactaactaactactcgtacgaccaacgacgggaggtggcgtggggtgtgggacgtacggtcggggaccgagggacgtccgtggtaccacgtccgtccctcgacgcccgtaccaaccgaaccgggaccctacggttaccggttcccttcccccggtccggcccgtccccgttccggacccgtcccgaacgggaccgaccctacccggtacccgacggtaccggaccgtaccgacccgggg

SEQ ID NO: 72139 - DNA, 731 bp, Homo sapiens
  misc_feature: GYAE6OF02JLO6T.21.26.C04.1.454.CMB.1.raw
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (465)..(465): a, c, t, g, unknown or other
  misc_feature (465)..(465): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacgccccccggaaacggccccggagtggcttgccactcatttacttggaatggatgaataaccactacgagcccatctcgtagacggaccaggcctaccaccctacgaaccggaaacggaaccacccggaacccaaaaaccgngggttacggtaccctaaacgaccgtacacccaaanacgtaccggaacccctacgtaggaaccacacgaccacactaacctacgtgtacncgaacgacgggaacgtcgggtacgtgggtggtacgggtaccgtaagggttccggggacgacggggacgttccgtacgggtccgtacccgtccttaccgtcctaccgtaccccgtaccgaacccggtaaccgggtcccgtaacgtcccggttacccccgttccccgtacgggtccccgcccggttaccgtcccggtaccggttaccggacccggtaccgtaccccggtacccggtacggaaccggtacccgaacccggtaacccggg

SEQ ID NO: 72140 - DNA, 628 bp, Homo sapiens
  misc_feature: GYAE6OF02JGU0S.21.26.C04.1.454.CMB.1.raw
  modified_base (345)..(345): a, c, t, g, unknown or other
  misc_feature (345)..(345): n is a, c, g, or t
  modified_base (358)..(358): a, c, t, g, unknown or other
  misc_feature (358)..(358): n is a, c, g, or t
  modified_base (422)..(422): a, c, t, g, unknown or other
  misc_feature (422)..(422): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattggaatgatgataaccactacagccatctctgaggaccaggctcaccctcacgaaggacaccgacaaaaccnggtcgtcctaacnctgaaccaacatcggaccccagtcggacacgacgccaacactactactgtcgacaacgacgggngtcggcgttggggtgtgggactacggtcggggacctaggggacgtccgtcgggtacctaccgtccgtaccgtccgacgtcccgtacccaaccgaacgggcccctagttccggttacccttccccgtgggacccgtccccgtacgccgtcccgaacgggacccgccgtaccccgtcccggaacggtaccgaccgaccgtaacccggg

SEQ ID NO: 72141 - DNA, 639 bp, Homo sapiens
  misc_feature: GYAE6OF02GXCBZ.21.26.C04.1.454.CMB.1.raw
  modified_base (231)..(231): a, c, t, g, unknown or other
  misc_feature (231)..(231): n is a, c, g, or t
  modified_base (315)..(315): a, c, t, g, unknown or other
  misc_feature (315)..(315): n is a, c, g, or t
  modified_base (438)..(438): a, c, t, g, unknown or other
  misc_feature (438)..(438): n is a, c, g, or t
  modified_base (480)..(480): a, c, t, g, unknown or other
  misc_feature (480)..(480): n is a, c, g, or t
tcagtcgtcgctcgcacgaccggtgctcgatttagtctagcgactttgggtttggggggtaaggaggaagactgacggtcctgctgctgaccatcccttcatgggtcttgtcccagatcaccttgaaggagtctggtcccacgctggtgaaacccacagacgaccctcaccgctgacctgcaccttctcttggttttcactcagtaccactgcaggtgggtgtgggctggntccgtcacggaccccccggaaaggccccggagtggcttgccactcatttatggaatgatgataaccactaacacgcccatcctntggacgaccacggctccaccctcaacgaacgacaccgaaccaaaaccaggtcgacctaacacctagaccaacagtacggacccccaagtggaaccacgacgacccaacactaactactcgtanccacgacgggaggtcggcgtgggtacgtcgggaacgttccgnggggtacccgagggaccgttccgtcggtcgacccgtctccgtaccgacgccctaccgaaccgaccggaccacgtaccggtcccttaccccgtcggaccgtccccgtcgtcccgtaccgaccggtacgaccgtacccgtccgacgacgtaccaccgacgg

SEQ ID NO: 72142 - DNA, 620 bp, Homo sapiens
  misc_feature: GYAE6OF02IXV0D.21.26.C04.1.454.CMB.1.raw
  modified_base (357)..(357): a, c, t, g, unknown or other
  misc_feature (357)..(357): n is a, c, g, or t
  modified_base (588)..(588): a, c, t, g, unknown or other
  misc_feature (588)..(588): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgactaaccactacagcccatctctgacggaccgaggcctcaccctcaacgaacggaccacccgaaccaaaaccgnggtacgtacctaacactacaaccaacagtacggaccccatacggacacacgaccacactactactgtcgacacgacggagtggcgtggggtacggtgggaccgtaccggtggggccgtaagggcgttccgtcggtccgtaccgtccgtcctccgacgccctaccgacccgaaccgggcccacgttcccgtacccgttccccgtcggcccgtcccgtcgtcctccgacggcnccgaccgtccggacgaccgaccacgtacccgg

SEQ ID NO: 72143 - DNA, 618 bp, Homo sapiens
  misc_feature: GYAE6OF02F4X5F.21.26.C04.1.454.CMB.1.raw
  modified_base (353)..(353): a, c, t, g, unknown or other
  misc_feature (353)..(353): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttattggaatgatgataaccactacagcccatctctgaggaccaggctcaccctcaacgaacggacaccgaccaaaaaccgnggtcggtacctaaacgactacggaacccaaacacgtacggaccccctagtcggaaccacacgccacaactactactgtcgacaacgacgggaggtggcgtggggtcgtacgggactacggtcggggaccgaggggtacgtccgtggtaccgtaccgtcctccgtcgacgccctacccgacgacggccctagtccggtcccttccccgcggaccgtcccgtcgcctcccgaggtaccgccaccgtccgaggacgacgaccgaccgg

SEQ ID NO: 72144 - DNA, 619 bp, Homo sapiens
  misc_feature: GYAE6OF02FWN2Y.21.26.C04.1.454.CMB.1.raw
  modified_base (357)..(357): a, c, t, g, unknown or other
  misc_feature (357)..(357): n is a, c, g, or t
  modified_base (560)..(560): a, c, t, g, unknown or other
  misc_feature (560)..(560): n is a, c, g, or t
  modified_base (602)..(602): a, c, t, g, unknown or other
  misc_feature (602)..(602): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatcctctgacggaccaggcctccaccctcaacgaacggaccacccgaccaaaaaccgnggtacgtacctaacactacgaacccaacactccggaaccccagtacggaaccacacgacccacactaactactcgtacgcaacgacgggagtggccgtggggtcgtgggaccttaggcggggccaggggcgttccgtggtaccaccgttcgtccctcgacgccctaccgaccgacggccctacgtccggttcccttcccccgnggcccgtcccacgtcctaccgacggacgccacccgtaccggngaccgacacctaccggg

SEQ ID NO: 72145 - DNA, 646 bp, Homo sapiens
  misc_feature: GYAE6OF02JNDL6.21.26.C04.1.454.CMB.1.raw
  modified_base (356)..(356): a, c, t, g, unknown or other
  misc_feature (356)..(356): n is a, c, g, or t
  modified_base (381)..(381): a, c, t, g, unknown or other
  misc_feature (381)..(381): n is a, c, g, or t
  modified_base (421)..(421): a, c, t, g, unknown or other
  misc_feature (421)..(421): n is a, c, g, or t
tcagtcgtcgctcgcacgaccggtgctcgatttagtctagcgactttgggtttggggggtaaggaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttatggaatgatgaataaccactacagcccatctctgacggccaggcctccaccctcacgaaggaccaccgaccaaaaaccgnggtcgtacctaacactcgaccaacntacggaccccagtcggacacacgccacatactactgtacncacgacgggagtcggcgttgggtcggtgggacctacggtcggggaccgtaggggactccgtaggtcccaccggttccgtcctaccgacgtcccgtacccgaccggaacggcccctaacgtcccgggttacccttccccggtcggcccgtaccccgtcggtaccctcccggacgggtacccgacccgtaccccggtaccggacggacgaccgaacccgacccgggg

SEQ ID NO: 72146 - DNA, 789 bp, Homo sapiens
  misc_feature: GYAE6OF02H4L8H.21.26.C04.1.454.CMB.1.raw
  modified_base (634)..(634): a, c, t, g, unknown or other
  misc_feature (634)..(634): n is a, c, g, or t
  modified_base (649)..(649): a, c, t, g, unknown or other
  misc_feature (649)..(649): n is a, c, g, or t
  modified_base (660)..(660): a, c, t, g, unknown or other
  misc_feature (660)..(660): n is a, c, g, or t
  modified_base (767)..(767): a, c, t, g, unknown or other
  misc_feature (767)..(767): n is a, c, g, or t
  modified_base (779)..(779): a, c, t, g, unknown or other
  misc_feature (779)..(779): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctcggatcccgtcaccggccccccgggtaaaaggccccggagtcggcttcgccacgtctatttattagggaaattcggaatcgaaacttaacccaacgttaccgacgacccctagtcctttcgacggaacggaacccgaaggggtcccttacccgtacccctaccgaaccgggtaaaccgggaaccaaaccccgggaaaccctaaaaaaccggtgggttaccggtaccttaaaccgacttacggaaccctaaacgaccgtaccggaaccccaggtacggaccaacgacgccctactaacgtactacgttcgcgaacctaacggaacggggtacgttcgggcggttcgggggttaagtacggggtaaccctcgggttccggggacggaggggtacccttccggtaggttcccncggttcctaacccgngccgttacccncccgaaacccgaacgggtcccaacgttcccggttccgttccccaacgggttcccgaacccgtccggttaccgacccgttacgacccggccttaacccggacccggtnaccgggaacccncggtacccgg

SEQ ID NO: 72147 - DNA, 868 bp, Homo sapiens
  misc_feature: GYAE6OF02I8ONS.21.26.C04.1.454.CMB.1.raw
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctntggacggaccaggcctccaccctnaaccggaacggaccacccgacccaaaaaccgtgggtcggtaccctaaacactacgaaccaacacgtccggaaccccagtacggaacaccgaacgaccctaactaacttaaccgtacgtacgtacgaccgaaccggaaccgggggtaacggttacggggtaccggtttacgggggttccggggttacgggggttaacccggttaccgggttaccgggggggtacccggtaacggggggtaaccggttccccgggttaccggggttaccccgtaaccccgggtttcccgttaccccgtttacccgtaaccggtccccccgttaacccccgtaaaccccgggtaaacccgggggtaccccccgtaaccggtttaccccgggtttaccccccgttttaccccccccgggttcccggggtacccccggtccccccggtttaccgggccccgttaacccccgggaccgggtaacccggtacccccggtaaccccggttacccgggaacccgggtaacccggtacccgaacccgggtaaccccgggg

SEQ ID NO: 72148 - DNA, 737 bp, Homo sapiens
  misc_feature: GYAE6OF02G5LTJ.21.26.C04.1.454.CMB.1.raw
  modified_base (410)..(410): a, c, t, g, unknown or other
  misc_feature (410)..(410): n is a, c, g, or t
tcagtcgtcgctcgcacgaccggtgctcgatttagtctagcgactttgggtttggggggaagaggaagactgacggtcctgctgctgaccatcccttcatgggtcttgtcccagactcaccttgaaggagtctggtcccacggctggtgaaacccacagacgaccctcacgctgacctgccaccttctcttgggttttcactcagtaccactgcaggtgggtgtgggctggatccgtcacggccccccggaaggccccggagtcggcttgcactctatttatggaatggatgactaaccactacgacgccctatctctaggacggaccacggtcctaccaccctcgaacgaaacgaccaacccgaacccaaaaaccgtgggttacgtacctaaacactacgaacccaacncgtaccggacccctagacggacaaccgacgacccaacgtaacttactaacctgtacgacaacccgggaagggacggtcggtccgggtggggttacggtacggggtacttaccgggcggggtacccggaggggttcccgtaccgttcgggtccctacgtcccgttccacccggtacgtccccctaccgaaccggaaccggccctaacgtcccggttttcccctccccgggtcggtaccccggcccccgttggttccccgtaaccggaaccggtccgtacccccgtaccgggtacccgaacggacccgttaccgacccggtacccgggg

SEQ ID NO: 72149 - DNA, 945 bp, Homo sapiens
  misc_feature: GYAE6OF02FYYN1.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtggtgggctggatccgtcacggaccccccggaaacggccccggagggtcgtcgtcgacctcctatttagtttaggtaagtagtagtagtaacgtaaacctaaacctaaccgtaacgacccgaaccttacctccgtcggtaacgggaacccgaaccggaccgtcccctaacccctaccctaaccggaaaaccgggaacccgaaaccccggaaaccccgaaaaaaaccccgtaaaccggggttaacccggggtttaacccgttaaaacccgtaaacccgtaacgtaaacccgtaaaaccgaaaccccgttacggaacccccgtaaaccgtaacggtaaccgaaccaaccggacccaaccgtaaccgtaaacctttaccgttacgttcgtaaccgaaccggtaaaccggggtagggtacgggtcggttcgggggttacgggttacggggaaccggttaccgggttcggggggacccggtaagggggtaccgtttacccgggtccgggttaccgtaccccggttcgttaccccgtccggaacgtcccccgttaaccccgaaccccggaaaccgggggtacccctaccgttcccggggttacccccttttcccccccggtaccgggtccccgtcccccggtccgttcccgggtaccccgtaaccggggtacgtccccgaaccccgttccgggaacccggtaacggcccggtaacccgaccgggtacccccgggg

SEQ ID NO: 72150 - DNA, 720 bp, Homo sapiens
  misc_feature: GYAE6OF02F1CS0.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcacctttgaaggagtctggtcccacgctggtgaaacccacagagaccctcacgctgacctgcaccttctctgggttttcactcagtaccactgcagtgggtgtgggctggatccgtcacgcccccggaaaggccccggagtcggcttgcactcatttatggaatgatgataaccactaacagcccatctctggacggaaccaggcctccaccctacgaaccggaaaggaccaacccggaacccaaaaaaccgtacgggttacggtacccttaaaccgaccgtacgaacccaaacacgtacgggaacccccagtacggacaacgacgacccaactaactaactacgtcgtcgaccacgaaccgggtagtggacgtggggtcgtacgggacttacggtggggaccgacgggacgttcccgtggtaccgacccgttccgtccgtaccgaccgtaccctcccgaaccgtaaccgggaccccgtacgttcccgggttaccccgtttcccccggtacgggtcccgtcccccggtacggtcccgttacccgaacggtccgtacccggtaacccgttacccggaaccggacggtaccccacggaccccgggg

SEQ ID NO: 72151 - DNA, 706 bp, Homo sapiens
  misc_feature: GYAE6OF02GZ0PQ.21.26.C04.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacggaccccccggaaaggccccggagtcggcttgcactcatttatggaatgatgaactaaccactacacgcccattcctctgacggaccaggctccaccctcaacgaacgaccaacccgaaccaaaaacgnggtcggtacctaacactacgaaccaaacacgtaccggaaccccagtacggaacacgaacgccaactactaactactacgtcgaccaacggacgggtacggtcggtacggtggggtacggtacgggtacgtacggtcggggaccggaagggtaccgtccggtacggtccgacccgtcgttcccgtacgaccgtcccgtacccaaccggaaccggtcccgtaacgttcccggttcccgttaccccccgtcgggtaccccgtccccgtccggtacccggtacccgtaaccggaccgtacccgtacccggtacccggtacggaaccgtacccggacgaccccgggg

SEQ ID NO: 72152 - DNA, 698 bp, Homo sapiens
  misc_feature: GYAE6OF02IA6P2.21.26.C04.1.454.CMB.1.raw
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccagctggtgaaacccacagagaccctcacgctgacctgcaccttctctgggttttcactcagtaccactgcagtgggtgtcgggctggatccgtccacggaccccccggaaaggccccggagtcggcttgccactctatttagttgaatgatagataaccactacagccctatctactcgaacggaccacgggtacctaccacccgtnaacggacggaaccaacccgaccaaaaaccgnggttacggtaactaacgactacggaacctaacgacgtaccggaccctaagtacggacaacgcgaccaacgtactacttaactgtacgcaccggacgggtacgttacgggtcgtggggtacgtacggggtaccttacggtcggggaccggaacgggtacgttccgtacgggtacctaccgttccgtaccgtacacgtcccgtacccgtaaaccggaccggtacctaccgttccggttaccctttccccgacggttacccgccgtaccgtccgtccgtaaccgcgtacccgaccggtcccggaacgcgtacccgagtacccggg

SEQ ID NO: 72153 - DNA, 746 bp, Homo sapiens
  misc_feature: GYAE6OF02IRQI5.21.26.C04.1.454.CMB.1.raw
  modified_base (332)..(332): a, c, t, g, unknown or other
  misc_feature (332)..(332): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactctatttattggaatgatgaataaccactacacgcccatctctggacggaccaggctccacccngaacgaacgaccaccgaaccaaaaccgnggtacgtaccctaanaccgtagaacccaacacgtcggaaccccagtacggaaccaacgacgacccacaacttacctacgtgtacgacgtaaccggaacggggtaggtcgggtacggtgggggttacggtacggggtaacctaccggggtcgggggtacccgaggggtaccgttccggttacgggtacccgtcccggtccttaccccgtacgtaccggtcccctacccgtaaccccggaacgggtcccctaacgggtttccccgtaccccgtttccccccggtacgggccccggtccccgtccggtacccgtacccggaaccgggtaacctacccccggtacccggtaccccgggtaaccggaccggtacccgaacccgccccgggg

SEQ ID NO: 72154 - DNA, 726 bp, Homo sapiens
  misc_feature: GYAE6OF02H7WR8.21.26.C04.1.454.CMB.1.raw
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggcttgcactcatttattaggaatgatgaactaaccactacagccatctctcgaggaccgaggcctaccaccctacacgaacggaccaccgaaccaaaaaccgnggtacggtacctaacactacgaaccaanacgtcggaaccccagtacggaccacacgacccaacaactaactacgtcgtcgaccgaacggacggggagtcgggtacgtggggtcggtagggaaccgttacgggtcgggggtaccgagggggtacgttcccgtacgggtaccctaacggttcccgttacccgtccgaccggtcccctacccgaacccgggaaaccgggtccccaaccggtttccccgggttaccccgtttcccccccgtggggtaccccgtccccggttaccgtaccgtaccccggtaaccgggcccgtaccccaaccccggttcccggaaacggtccggaccccgaccggacccgggg

SEQ ID NO: 72155 - DNA, 687 bp, Homo sapiens
  misc_feature: GYAE6OF02G3IW1.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtcggcttgcactctatttattggaatgatgataaccactacacgcccatctctgacggaccaggctccaccctcacgaacggacctacccgaaccaaaaccgaggtacgtacctaacactacgaaccaaacactaccggacccagtacggacacgacgaccacactactactgtcgacacgacgggagtcggcgtggggtcgtacgggacctacgggttcggggaccgtaggggtaccgtccggtcggtacccgtacccgttcctacccgttaccgacgtccccgtacccgaacccgtaaaccgggacccctaaccggtcccggttcccgttcccccgtacgggtccccgtccccgttcggcccgttccccggaacgggtaccgacccgtaacccggtcccggaaggtacccggaccgaccgtacccgggg

SEQ ID NO: 72156 - DNA, 711 bp, Homo sapiens
  misc_feature: GYAE6OF02I21MC.21.26.C04.1.454.CMB.1.raw
  modified_base (304)..(304): a, c, t, g, unknown or other
  misc_feature (304)..(304): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcaggtgggtgtgggctggatccgtcacgcccccggaaaggcccggagtggcttgcactcatttatggaatgatgactaacactacagccatctcngaggaccacggctaccacctacaaccgaaggaaccaaccgaacccaaaaacacggtacggtaccctaaacgacctacgaacccaacaacgtaccgggaccccaagtacggaaccacgaaccgacccgtaaactaactaaccgtaaccgttacggtacgaccgaacgtaaccggggacggtacgggtccggttaggggtacggttacgggggaacctacgggttaccggggaccgtaacggggtacggttaccggtcggtacccgtaccgttcccgtaccgttcgaccgtccctacccgaccgtaaccgggccctaacggtcccgttccgtaccccgtcggacccgtcccgtaccgccgtccgtacggcgacccgtacccgtaccgacggccgaccgtacggacccgg

SEQ ID NO: 72157 - DNA, 598 bp, Homo sapiens
  misc_feature: GYAE6OF02FYKBD.21.26.C04.1.454.CMB.1.raw
  modified_base (352)..(352): a, c, t, g, unknown or other
  misc_feature (352)..(352): n is a, c, g, or t
  modified_base (503)..(503): a, c, t, g, unknown or other
  misc_feature (503)..(503): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatcctctgacggaccaggctcaccctcacgaaggaccaccgaccaaaaaccnggtcggtacctaaaccactacgaaccaactacgtacggacccccagtcggacaacacgccacatactactgcgcacacgggagtggcgtgggtggtgggactacggtgggccgagggcgtccgtcggtcacccgtcctccgtcacgtcccnccaccgacggcccagtccgtccttccccgtcggcccggtccctcgtccgtcccgacggtacgccgtacccgtccgaacgcgaccgacgtaccggg

SEQ ID NO: 72158 - DNA, 661 bp, Homo sapiens
  misc_feature: GYAE6OF02GPT0U.21.26.C04.1.454.CMB.1.raw
  modified_base (195)..(195): a, c, t, g, unknown or other
  misc_feature (195)..(195): n is a, c, g, or t
  modified_base (346)..(346): a, c, t, g, unknown or other
  misc_feature (346)..(346): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcnctcagtaccactgcagtgggtgtgggctggatccgtcacgccccccggaaaggccccggagtcggcttgcactcatttatggaatgatgataaccactacagcccatctctgacgaccaggctcaccctcacgaagacaccgacaaaaccngtcggtacctaacactacgaaccaacactacggaccccagtacggacacacgaccactaactactactgtacgtacaacgacgggtagtacggtcgtggggttacgtcgggtacgttaacgtcggggaccgaaggggtactccgtacggtcctacccggtcgtccctcgaccgtccctacccgaaccggtaacggccctaacgttcccggtacccgtttcccccgacggtcccgtccccgtacggtacccgttaccgaacgggtaccgtaccgtaacccggttcccgacggaaccgtaccgaaccggtacccggg

SEQ ID NO: 72159 - DNA, 703 bp, Homo sapiens
  misc_feature: GYAE6OF02JC8H0.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcagtgggtgtgggctggatccgtcacggaccccccggaaaggccccggagtcggcttgcactcatttatggaatgatgactaaccatacagccatcctctgacggaccaggcctaccgaccctcgaacggaacgaccaccgaaccaaaaaccgtggtacgtacctaacactacgaaccaacacgtaccggacccctatcggaacaccgacgccaactactaactacagtcgacaacgacgggcgtaggcgtgggtgacgggtactacggtcggggccgaagggtacgtcccgtagggtaccacccggttaccttcccgtacgtaccgtacccgtaacccgaaccgaaccgggtacccccgtagttaccccgggttcccccgtttacccccgtaccggggtaccccgtccccgtccggttacccgtaccccgaacggggacctaccccgtacccggtaacccggaacgggtacgaccccggtaacggtaccccgggg

SEQ ID NO: 72160 - DNA, 719 bp, Homo sapiens
  misc_feature: GYAE6OF02HYNSA.21.26.C04.1.454.CMB.1.raw
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
  modified_base (706)..(706): a, c, t, g, unknown or other
  misc_feature (706)..(706): n is a, c, g, or t
tcagtcgtcgctcgcacgaccggtgctcgatttagtctagcgactttgggtttgggggggtaaggagggaaggactgacggtccgtgctgctgaccatcccttcatgggtcttgtcccagatcaccttgtaaggagtctggtcccacgctggtgaaacccacagagaccctcacgctgacctgccaccttctctggtttcactcacgtaccactgcagtgggtggtgggctggatccgtcacggccccccgggaaaggccccgggagtcggcttcggcaccgttctaagtttactttaggaactagataggtaactaaccgaactactaacgccccaatttcctacttacggaacggaacccgtacgggactccctacccgtaccgaacggaaacgggtaaccacccgaaaccgaaaaaccgtcgggtacggtacccttaaacaacctacgaacaaccganccgggaaaccccngtaacgacgaacacgacctacaagttactaactgtcactaccgaacgggacggtggaccgtgggtaggtcgggtacgtaacggtcggggacgagggtcctaggtacggcgttaccgaccctccgtacgaccgtcctacccgaacgtacccgggaccacgttacgtcccttaccccgtcggaccggccttaccgctacccggacgtacgtaccgccggtaccgaacgggtacnccgacgtacccgg

SEQ ID NO: 72161 - DNA, 637 bp, Homo sapiens
  misc_feature: GYAE6OF02GQTMV.21.26.C04.1.454.CMB.1.raw
  modified_base (585)..(585): a, c, t, g, unknown or other
  misc_feature (585)..(585): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgacccccggaaggccccggagtcggcttgcactcatttatggaatgatgataaccactacagcccactctctgacggaccaggcctacaccctacacggaacggaccacccgaaccaaaaaccgtcggtacggtacctaacactacgaaccaacacgtacgaaccccagtacggacacacgccaactactactactgtacgacacgacgggtagtacgggcgtggggtgtacgggtactacgggtcggggaccgagggtacgtccgtggtaccgtacccggttcctcccgtacgaccgtccctacccgacgaaccgggccctacgtccggttacccttcccgcgggtcccncccgtcacccgtcgacggccgccctacgtaccgacggcgaccgacgtaccgg

SEQ ID NO: 72162 - DNA, 776 bp, Homo sapiens
  misc_feature: GYAE6OF02GQNKH.21.26.C04.1.454.CMB.1.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaaggccccggagtggctgcactcatttattggaatgatgataaccactacagcccatcctctgaggaccaggcctccaccctnaacggaacggaccacccgaaccaaaaaccgnggtacggtacctaacactcgaaccaaacncgtaccggaccccagtcggaacaacgacgaccaactaacttaactacgtcggtacgaccgtaaccggacgggtaagtcggggtacgttcgggggtaggtacggggtaccttaccgggtacgggggacccgaaggggggtaccgttcccgggtacgggttacccgtaccccggttcccgtttaccccgtacccggtaccggtacccccgttacccggaaaccccggtaaaccgggggtcccccttaaacggttccccggggtttcccctttaccccccgggtccgggtaccccggttccccgtccggtccccgtacccggtaaccggggtaccgtaccccgacccggttaacccggaccggtaacccggtaccgacccggtaaccccgggg

SEQ ID NO: 72163 - DNA, 714 bp, Homo sapiens
  misc_feature: GYAE6OF02GPZO1.21.26.C04.1.454.CMB.1.raw
  modified_base (381)..(381): a, c, t, g, unknown or other
  misc_feature (381)..(381): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggcccggagtcggcttgcactctattatggaatgatgaataaccactacagcccatctcgtgacggaccaggcctcacctcaacgacggaccaccgaaccaaaacgcggtcgtacctaacgactacgaaccaacacncggaaccccagtacggacacgacgtaccgactaactactactcgtacgaccgaacgtacgggtaggtacggtcggtacggggtaggtacggggtaccgttaacgggtcggggtacccgtaggggtacgttcccgggtaggttacccgtaccgttccgtaccgttacgtaccgtaccccgttacccgaaccgtaaccgggtccccttaacggttcccggttaccccgtttccccgcgggttccccggtaccgttccgtacccgtaccgggtacccggtacgacccggttacccgtaaccgggacccggtaacggtcccgtacccggtacccggg

SEQ ID NO: 72164 - DNA, 609 bp, Homo sapiens
  misc_feature: GYAE6OF02JAL7T.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgacggaccaggcctcaccctcaacgaaggacacccgaccaaaaaccnggtacggtacctaaacactacgaaccaacactcggaacccccagtacggaacacgacgcccaacaactactactgtcgacacgacgggagtggcgtgggtgtcgggactacggtcgggaccgagggacgtcgtggtccaccgtctcccgtcgacgtccctaccgaccgaacgggccccagtccggttccttccccgtggcccggtccctcgcctccgacggacgcccgacccgtccggacgacgaccaccgaccggg

SEQ ID NO: 72165 - DNA, 627 bp, Homo sapiens
  misc_feature: GYAE6OF02HBM5W.21.26.C04.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgaataaccactacagcccatctctgaggaccaggctccaccctacacgaaggaccaccgaccaaaaccnggtacgtacctaacactcgaaccaacacgtacgaccccagtcggacacacgccacactactactagtcgacacgacgggaggtggcgtgggtggtgggactacggtggggaccgagggacgtccgtcggtccgtaccgttcctcccgtcgacgtcccgtcccgaacccgtaacgggccccacgtcccgggttcccttcccccgtcggccccggtcccctccggccgtacccgacggaccgcccgacccgtacccgacggacgaccgacgacccgg

SEQ ID NO: 72166 - DNA, 702 bp, Homo sapiens
  misc_feature: GYAE6OF02HIOKY.21.26.C04.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaaccccacagacgaccctcacgctgacctgccaccttctcgttgggttttcactcagtaccactgcaggttgggtggtgggctggacttccgtcaccggaccccccgggaaaggccccggagtcggtctgctactctatttacgttggaatgactagtaactaaccactacacgccctatcgtctggacgaccgacggtctccacctaccgacgaacggaccaaccgaaccaaaacgtggtacggacctaacgactacgaaccaanagtaccgaccctagacggacacacgaccatactacgtactcgtacgacctacggacgggtacgtacgggtccggtggggttcggtacgggtaccgtaacgggtccggggaccggacgggtacggtacgtaccgggtccgtaccggttccgtaccctacgaccgtacccgtacccgtaccgaacccgggcctaccggttacccgtcccgttaccccgtcggtcccgcccgtccgtcaccggtacgtccgacccgtaccggacccgaccggtacgacccaggacccggg

SEQ ID NO: 72167 - DNA, 807 bp, Homo sapiens
  misc_feature: GYAE6OF02ILUA7.21.26.C04.1.454.CMB.1.raw
  modified_base (517)..(517): a, c, t, g, unknown or other
  misc_feature (517)..(517): n is a, c, g, or t
tcagtcgtcgctcgcacgaccggtgctcgatttagtctagcgactttgggtttgggggggtaaggaggaagactgacggtccgtgctgctgaccatcccttcatgggtcttgtcccagatcaccttgaaggagtctggtcccacggctggtacgaaacccaccgagacgaaccctcaccgctcgacctgccaccttctcgttgggttttccactctacgtaccactcgcaggtgggtggtcgggcgtaggatccggtccaaccggacccccccggaaacgggccccgggacgtcgggtccttcggcaccttcgtattttacgtggtaaatgtatacgtaactaaccactaacgacgccctattcctacgtcggaacgggaccgacggtcctacctaccccgtacgaaacggtaacggaacccaacccgaaccccaaaaaacgtcggggttacggtaaccctaaaccgaactacgaaccaaacgtacgtaccgaacccccgtaagtacggaaccctanaaacccgtaccgaccaaacttacccgttacgtacgtacgaccgacggtaaccgggaagggtcggtcggtagggtcgggtacggtaccgtacgggtaccgggccggtaacgggtaccgtcgtacggtacctaccggtccttaccgacaccgtacccgtcccgaaacccggtaaccggccctacggttacccgtcccgttcccccgtcgggtccccgtcccgttccggacccgttccggaacgcccggaacccgtcccggacggtacccggaacgccccgaaggtacccggg

SEQ ID NO: 72168 - DNA, 735 bp, Homo sapiens
  misc_feature: GYAE6OF02JPZ0V.21.26.C04.1.454.CMB.1.raw
  modified_base (316)..(316): a, c, t, g, unknown or other
  misc_feature (316)..(316): n is a, c, g, or t
  modified_base (675)..(675): a, c, t, g, unknown or other
  misc_feature (675)..(675): n is a, c, g, or t
tcagtcgtcgctcgcacgaccggtgctcgatttagtctagcgactttgggtttgggggggtaaggaggaagactgacggtcctgctgctgaccatcccttcatgggtcttgtcccagatcaccttgaaggagtctggtcccacgctggtcgaaacccacagagaccctcacgctgacctgcaccttctctgggttttcactcacgtaccactgcaggtgggtggtgggctggatccgtcacgccccccggaaggccccggagtggcttgacactcatttatggaatgatgataaccactacacgtcccattcctgnggaacggccaaggcctacccaccctacgaaccggaaaggtacccaacccgaaccgaaaaacccgtgggggttccgtaccctaaaccacgttcgaaacccaacaccgttaccggggaaccccctaagtcgggaacccacgtaaccgacccaacgtaacttaacctcgtacggacgtccgaaacggtaccgggtaagtcgggtaccggtgggttaggtacgggtacctacggggttacgggggacccgtagggggtaaccttccgttagggtcccgaccggttcctacccgttccggacccgtaccctacccgaccgaaccgggaccctaaggtcccgggttccccttcccgcgggtcccnccccttggtacctaccggacggtaccgccgtaaccgtccgaagacggacctcggaccggg

SEQ ID NO: 72169 - DNA, 609 bp, Homo sapiens
  misc_feature: GYAE6OF02HKZ0B.21.26.C04.1.454.CMB.1.raw
  modified_base (349)..(349): a, c, t, g, unknown or other
  misc_feature (349)..(349): n is a, c, g, or t
  modified_base (464)..(464): a, c, t, g, unknown or other
  misc_feature (464)..(464): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaagaccaccgaccaaaaaccgnggtcgtacctaacactcgaaccaacactaccggaaccccagtacggaaccacgagcccaacaactaacctactgtacgcaacgacgggagtcggcgtgggtggtgggactacggnggggaccaggggacgtccgtggtcctaccgtctccgtcgacgtccctccgaaccgaacgggcccacgttcccggtcccttcccccgtcggtcccgtccccgtcgccctccgacggacgccacccgtccgacgacgccacgaccgg

SEQ ID NO: 72170 - DNA, 757 bp, Homo sapiens
  misc_feature: GYAE6OF02I45AV.21.26.C04.1.454.CMB.1.raw
  modified_base (367)..(367): a, c, t, g, unknown or other
  misc_feature (367)..(367): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggtttcactcagtaccactgcagtgggtgtgggctggactccgtcacggacccccggaaaggccccggagtggcttgcactcatttatggaatgatagataaccactacacgcccatctactacggacggaccacggcctaccaccctacgaacggaacgaccaaccgaaccaaaaaccgnggtacgacctaaacactacgaaccaacacgtaccggacccagtacgaacacgacgaccaacgtactaactacgtacgtacgacaacggtacgggtaggtcggcggttaggggtcggtacgggtaaccgttagggtaccgggggtaccgaggggtaccgttccgtaacggtcccgtaaaccggttcccgttacccgtaccggtaccgtaccccgttaacccgaaaccgggtaacccgggacccgttaacgttccccggggtttaaccccctttcccccggtccggggtacccccggtcccttacccgggtacccttaacccggaacggtcccggaaccccgttaccccggtacccggaacggaaccggtcccgtaacccgggaccccgggg

SEQ ID NO: 72171 - DNA, 606 bp, Homo sapiens
  misc_feature: GYAE6OF02G5MPO.21.26.C04.1.454.CMB.1.raw
  modified_base (357)..(357): a, c, t, g, unknown or other
  misc_feature (357)..(357): n is a, c, g, or t
  modified_base (505)..(505): a, c, t, g, unknown or other
  misc_feature (505)..(505): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaggccccggagtcggcttgcactcatttagttggaatggatgactaaccactacacgcctatctctgacggaccaggcctccaccctcgacgaaggaccaccgaccaaaaccgnggtcggtacctaacactacgaaccaacacgtaccggaccccagtacggacacgacgaccactactactactgtacgacgacgacgggagtcgggcgtgggtggtacgggtaaccgtacggtcggggcgagggtacgtccgtcggtccnccgtctaccgtcgacgccgtaccgacgaaccggcctagtccgtcctcccgtgcccgcctcgcctccgacggtccaccgaccctcgacgcgaccacgtccgg

SEQ ID NO: 72172 - DNA, 568 bp, Homo sapiens
  misc_feature: GYAE6OF02IOXJS.21.26.C04.1.454.CMB.1.raw
  modified_base (325)..(325): a, c, t, g, unknown or other
  misc_feature (325)..(325): n is a, c, g, or t
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtggtgtgggctggatccgtcacgccccccggaaaggccccggagtggcttgcactcatttatggaatgatgataaccactacagcccatctctgacggaccaggctcaccctnacgaagaccacgccaaaacnggtgccaanactgaccaacactcggaccccatacggacacacgaccacatacactgcgacacgacggagtggctgggtgtgggactacgtgggaccgagggcgtctggtacaccggtctccgtcacgccctaccgaccgaacgggccctacgtccggtcctcccccgtggcccgccctccgcctcccgacggcgaccaccctccgacggacgcgaccgtcggg

SEQ ID NO: 72173 - DNA, 692 bp, Homo sapiens
  misc_feature: GYAE6OF02F2R6U.21.26.C04.1.454.CMB.1.raw
  modified_base (613)..(613): a, c, t, g, unknown or other
  misc_feature (613)..(613): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggtcttgcactctatttagtggaatgatgactaaccactacacgccctatctcgtaggacggaccaggcctaccaccctacgaacgaacgaccaaccgaacccaaaaacgtggtacgtacctaacactacgaaccaacacgtaccggaccccagtacggaaccacgacgaccacactacgtactggtacgaccaacggacgggtagtcggcggttggggtacggtcgggaccttacgggcggggaccgtaggggtacctccgttacggtccgtacccggttcctacccgtacgacccgtaccctacccgaacccggtaaccggccctaggttccccggttcccgttacccccggnggtccccgtcccgtgtacccgtccggtaacggaccgtcccgtacccggtaccggaagacccggtaccacggtacccggg

SEQ ID NO: 72174 - DNA, 678 bp, Homo sapiens
  misc_feature: GYAE6OF02GY2L5.21.26.C04.1.454.CMB.1.raw
  modified_base (360)..(360): a, c, t, g, unknown or other
  misc_feature (360)..(360): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctcgtgacggaccaggcctccaccctcgaacggaacggaccacccgaaccaaaaaccgnggtacgtacctaacacgtacgaacccaacactacggaacccctagtcggaacaaccacgacccaactactaactacgtgtacgccgaacgacgggacgtacgggtcgtgggggtcggtcgggacgttacgggtcggggccgaaggggtacgtcccgttcgggtaccgtacccgttcctacccgttcgaccgtccctcccgaacccggtaaccgggccctacgttccccgttccccttccccggtcgtcccggtccccgtcgtcccgtaccgacggaccgacccgtacccgtccggaacggcgtaccgacggacccggg

SEQ ID NO: 72175 - DNA, 631 bp, Homo sapiens
  misc_feature: GYAE6OF02GMI0D.21.26.C04.1.454.CMB.1.raw
  modified_base (302)..(302): a, c, t, g, unknown or other
  misc_feature (302)..(302): n is a, c, g, or t
  modified_base (359)..(359): a, c, t, g, unknown or other
  misc_feature (359)..(359): n is a, c, g, or t
  modified_base (560)..(560): a, c, t, g, unknown or other
  misc_feature (560)..(560): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagccatcnctgaggaccagctcaccctcacgaagacaccgaccaaaacagtgtacctaacactanaaccaacatcggacccatcgacacacgccaacagtaactacgtgtacgacacgaacggggacgtcgggcgtacggggtggacgggtacgtaacgtgggggacccgagggggtacgtaccggtcggtaccgtacccgttaccttcctaccgacgccctacccgaacccgaacgggtccccagtaccggtacccttcccccgngggtcccgtcccgtacggcccgtccgaagggaccgaccaacccgtcggaccggacgaccgtaacgaccggg

SEQ ID NO: 72176 - DNA, 639 bp, Homo sapiens
  misc_feature: GYAE6OF02G8X3Y.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggactccgtcacggaccccccggaaacggccccggagtcggcttgcactctatttattggaatgatagaataaccactacacgcccatcctctgaggaccaggcctccacctcaacgaacggaccacccgaaccaaaaccgaggtcgtacctaacactacgaaccaacactccggaccccagtcggaacacacgaccacactactactgcacacgacgggagtcggcgtgggtgtcgggtactacggtcggggacgaggggtacttccggtacggtccgaccgttcctccgtcgacgccctaccgaaccgtacgggaccctacggtccgtcccgttccccgtcggcccgtcccgtaccgtccgtcccggacgtccgacccgtaccgtacccggtacgtaccggccacgtcccggg

SEQ ID NO: 72177 - DNA, 684 bp, Homo sapiens
  misc_feature: GYAE6OF02FZJQT.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtggctggatccgtcacgaccccccggaaaggcccggagtggcttgcactcatttattggatgatgactaaccactacacgcccatctctagacggaccaggcctcaccctcaacgaagacaccgaaccaaaaccgaggtacgtacctaacactacgaaccaacactacggaccctagtacggaccaacgcgacccgaactactaactactgtacgaccaacgacgggtagcggtcgttgggaggtcggacctaggttcggggccgtaaggggacgttccgtacggtccgacccgttccgtacccttgaccgtacccgtaccgaacccgggtaacgggcccccttaggtccccgggttaccctttcccccggacggtaccccggtccccgttaggtccccgtacccggtaggtaccgtaccccggtacccgttacccggaacgtaccggacccgtacggtaaccggg

SEQ ID NO: 72178 - DNA, 692 bp, Homo sapiens
  misc_feature: GYAE6OF02GXFMT.21.26.C04.1.454.CMB.1.raw
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcacttagtaccactgcagtgggtgtgggctggatccgtcacgcccccggaaaggccccggagtggcttgcactctatttattggaatgatgataaccactacagcccatctcngaggaccaggtctcaccctcgacgaaggaccaccgaaccaaaaacgnggtcgtacctaacnctacgaaccaacacgtcggacccagtacggaaccacacgacctaacactaacctactgtcgacgacgacgggaaggtcggcgttagggtcggttacgggaaccgtaccggtacggggaccgaacggggtacgttcccgtgggtacccgtaccggttacctcccgttacgaccgtcccgtacccgaacccgaacggggtacccctacggttcccggttacccttacccccggtcggtacccggccccgttcggtacccgtcccgaacgggtaccgccccggtaaccctcccggaaacgcccggtacctaccggacgtccccgggg

SEQ ID NO: 72179 - DNA, 637 bp, Homo sapiens
  misc_feature: GYAE6OF02JJB6U.21.26.C04.1.454.CMB.1.raw
  modified_base (570)..(570): a, c, t, g, unknown or other
  misc_feature (570)..(570): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacggccccccggaaaggccccggagtggcttgcactcatttatggaatgatgaactaaccactacacgcccatctctaggacgaccaggcctcaccctcgacgaacgaccaccgaaccaaaaccgcggtacgtacctaacactacgaaccaacgacgtaccggaccccagtacggaccaacgacgacccaactactacctactgtacgacacggacgggtagtcggcgtggggtagtcgggacgtacggcggggaccgagggtacgtccgtcggtaccaccgtcctcctccgacgccctaccgaaccgacggccctacgttccggtcccttccccgnggtccccgtcccgtgacccgtacgacggaccgccgtacccgtacgaccggtacgccgacgtaccggg

SEQ ID NO: 72180 - DNA, 618 bp, Homo sapiens
  misc_feature: GYAE6OF02GW2RX.21.26.C04.1.454.CMB.1.raw
  modified_base (349)..(349): a, c, t, g, unknown or other
  misc_feature (349)..(349): n is a, c, g, or t
  modified_base (464)..(464): a, c, t, g, unknown or other
  misc_feature (464)..(464): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgacggaccaggctccacctcaacgacggacaccgaccaaaaccnggtacgtcctaacactgaccaacatcggacccagtgacacagccacactactacgtgtgcacgacgggagtggcgtgggtgtagggctaggtgggccaggggcgtccgtggtccnccgttctccgtcgaccgtccgtacccgaaccgaacgggtccctaacgtcccgggtttacccttaccccccggtggccccgtccccgtcggcccgttacccgacgggtaccgacccgtacccgtcccggaaggaccgaccgtaccgaacccgggg

SEQ ID NO: 72181 - DNA, 618 bp, Homo sapiens
  misc_feature: GYAE6OF02GVQ7G.21.26.C04.1.454.CMB.1.raw
  modified_base (351)..(351): a, c, t, g, unknown or other
  misc_feature (351)..(351): n is a, c, g, or t
  modified_base (447)..(447): a, c, t, g, unknown or other
  misc_feature (447)..(447): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtggcttgcactcatttatggaatgatgataaccactacagcccatctctgacggaccaggctcaccctcacgaaggaccaccgaccaaaaaccnggtacggtcctaacactgaaccaacatcggaccccatcggacacagccacatactactgtcgacacgacggtagtggcgtgggtgtgggactacgnggggccaggggcgtcgtcggtccgtaccgtctcctcgacgcctaccgaaccgaacgggacccctacgttcccgggttcccgttccccccgtgggccccgtccccgtcggtccctacccgacgggtaccgtacccgacccggttcccggaaggaccggaccaccgaccgggg

SEQ ID NO: 72182 - DNA, 752 bp, Homo sapiens
  misc_feature: GYAE6OF02F7X7T.21.26.C04.1.454.CMB.1.raw
  modified_base (355)..(355): a, c, t, g, unknown or other
  misc_feature (355)..(355): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactctatttatggaatgatgataaccactacagcccatctctgacggaccaggctaccaccctcaacggaagaccaaccgaccaaaaaccnggtacgtaccaaacactacgaccaaacacgtaccggacccagtacgacaccgacgaccaacactaactacgtacgtgaccgaaccggacggggtacggtacggcggttgggggtcgggtacggggaccgttacgggtccggggggaccgtaacgggggttaccggttaccgttccgggtacccgtaaccccggtttccgtcccgttacccgaaccggtccccgttaaccccgaaacccgggacccgggcccccgttaacgttccccgggtttccccttccccccgggtgggcccccccggtacccgttccgggtaaccccctacccgggtaacgggacccggtaccccgtaacccccgtacggaacccggtacgaccccggaccggtaaccccgggg

SEQ ID NO: 72183 - DNA, 793 bp, Homo sapiens
  misc_feature: GYAE6OF02HQOTD.21.26.C04.1.454.CMB.1.raw
  modified_base (282)..(282): a, c, t, g, unknown or other
  misc_feature (282)..(282): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctgggtcgaaacccacagacgaccctcacgctgacctgccaccttctcgttgggttttcactcagtaccactgcaggtgggtgtgggctggactccgtccaccggcccccgggaaacggccccggagtcggctcgcactntatttagtggaatgatagaactaaccactacacgcccatctctggaacggaccgaggcctaccaccctacgaacggaacgaccaaccgaacctaaaaaccgtggtacgtaccaacactcgaaacccaacgtacgtaccggaacccaggtacggaaccacgaaccgacctaacctaacgttaaccttaaccgttacgtaccgaaccgaaccgggtaacgggtacgggtacgggtcgggttagggggtcgggttacgggtaccggttacgggtaccgggggtacccggaacgggggtaccgttcccggtacgggttaccctacccggttacccgtcccgtaccgacccgtaccccgttacccgaaacccggtaaccgggcccctaaccggttcccggttaccccgtttcccccggaggggtacccctcccggtacccgacccggtacccggaccggtacccgtacccgtacccggtacccgtaacggaccgtaccggaacccgtaccccgggg

SEQ ID NO: 72184 - DNA, 586 bp, Homo sapiens
  misc_feature: GYAE6OF02G4XJP.21.26.C04.1.454.CMB.1.raw
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (407)..(407): a, c, t, g, unknown or other
  misc_feature (407)..(407): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgaggaccnggctcaccctcacgagacaccgaccaaaaccgnggtgtcctaacactagaaccaacatacggaccccatcggaacacacgccacactactacngtcgcacgacgggagtggcgtgggtgtagggactacggtgggaccgagggacgtccgtggtccgaccgtctcccgtcacgccctccaccgaccgggcccagtcccggtccttccccgtggcccgtccctcggccctaccgacggacgccgacccgtccggacgacgaccgacgaccggg

SEQ ID NO: 72185 - DNA, 650 bp, Homo sapiens
  misc_feature: GYAE6OF02J2QA8.21.26.C04.1.454.CMB.1.raw
  modified_base (298)..(298): a, c, t, g, unknown or other
  misc_feature (298)..(298): n is a, c, g, or t
  modified_base (424)..(424): a, c, t, g, unknown or other
  misc_feature (424)..(424): n is a, c, g, or t
  modified_base (576)..(576): a, c, t, g, unknown or other
  misc_feature (576)..(576): n is a, c, g, or t
  modified_base (625)..(625): a, c, t, g, unknown or other
  misc_feature (625)..(625): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgccccccggaaacggccccggagtggcttgcactcatttatggaatgatgactaaccactacncgcccatctctgacggccagctccacctcacgaacggaccaaccgaacccaaaaccgtggtacgtacctaaccactacgaccaacagtaccggaccccagcggacacacgaccacactactacgtntgaccgtacgacgggtacgtggcggtgggttacggacgggtacgtacggtcggggtaccgaggggtcctaccgtcggtacctacccggtctacccgtacaccgtccctacccgaacgtaccgggccctacgttcccggtcccttcccccggnggtcccgccccgttagcccgtacccggaggtacccggcccttacccggnggaaccgcggtacccagtccccggg

SEQ ID NO: 72186 - DNA, 674 bp, Homo sapiens
  misc_feature: GYAE6OF02JTKXB.21.26.C04.1.454.CMB.1.raw
  modified_base (351)..(351): a, c, t, g, unknown or other
  misc_feature (351)..(351): n is a, c, g, or t
tcagtcgtcgctcgcacgaccggtgctcgatttagtctagcgactttgggtttggggggtaaggaggaagactgacggtcctgctgctgaccatcccttcatgggtcttgtcccagatcaccttgaaggagtctggtcccacgctggtgaaacccacagagaccctcacgctcgacctgcaccttctctaggttttcactcagtaccactgcagtcgggtggtcgggctggactccgtccacggcccccccggaaacggcccccggaaggtcggtcgttcgccactcctatttacttggaatggataggataaaccaactacacgcccatctacgtgacggaccaggtccnccgtaccctcaaccggacgaccaccgtaacccaaaaccgtaggtaccgtaccgtaaccactacgacctaacactaccggaccccagtacggacaaccgtacgacctaccgactacgtaactcgtcgacgacacgggaggtcgacgtggggtcggtacgggaacgttccggtagggacgacgggtcgtccgtggtcctaccgtcctcgaacctcgaccctaccgacgtccggacctcgtcccgtccgttaccccgtcgcccgtacccgtcggtactcccgacggtacgacccgtacccgtccggtacgccgaccgtaccgccgg

SEQ ID NO: 72187 - DNA, 624 bp, Homo sapiens
  misc_feature: GYAE6OF02I16O9.21.26.C04.1.454.CMB.1.raw
  modified_base (315)..(315): a, c, t, g, unknown or other
  misc_feature (315)..(315): n is a, c, g, or t
  modified_base (346)..(346): a, c, t, g, unknown or other
  misc_feature (346)..(346): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgaataaccactacagccatctctgacggacnggctcacctcacgaagacaccgaccaaaacnggtcgtaccaacactgaccaacatacgacccagtcgacacacgccacatactactgcgcaacgacgggagtcggcgtcggggtgtacggacctacgtggccgaccgagggtacgtccggtcggtacccgtaccggttcccttcccgtaccgacggtccccttacccgaaccggtaaccgggccctacgtcccggttccccgttccccgtacgggcccgtcccgttcgacccgtaccgacggaccgccgtacccgtacccggacgacgtcccaaccggg

SEQ ID NO: 72188 - DNA, 701 bp, Homo sapiens
  misc_feature: GYAE6OF02F7IBF.21.26.C04.1.454.CMB.1.raw
  modified_base (318)..(318): a, c, t, g, unknown or other
  misc_feature (318)..(318): n is a, c, g, or t
  modified_base (349)..(349): a, c, t, g, unknown or other
  misc_feature (349)..(349): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagcccatctctgacggaccagcnccacctcacgaagaccaccgaaccaaaacgnggtacgtacctaacactacgaaccaacactacggaccccagtcggacaacacgaccactactactacgtgtcgtaccgaacgacggggtacggtgggtacgttgggggttaggtcggggtaaccgttacgggttacgggggacccggtaacgggggtaccggttcccgtcgggtccgtacccggtcgttccccgtacgtaccgtaccccgtcccgtaacccggaaccggtaccccgtaacggttcccgggttccccgttcccccgtacgggtccccggcccgttccgaccgttcccggtaacggacccgacccgtacccggtacccggacggaacgccgtacccacccgggg

SEQ ID NO: 72189 - DNA, 693 bp, Homo sapiens
  misc_feature: GYAE6OF02IEJ9C.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtggtgggctggatccgtcacgccccccggaaaggccccggagtggcttgcactcatttatggaatgatgataaccactacacgacccatctctgaggaccaggcctccaccctacgaacgaacggaccaacccgaacccaaaaaccgacgggtcggtaccctaaacacctacgaaccaaacagtaccggaaccccagtacggacaacacgaccaactactaactactggtcgaccacgaacgggtagtgggcgtggggtggtacggggaccttacgggcggggaccgaggggtacgtccgtggacccgtacccgtcctccgtaccgacgcccctaccgaaccgaaccgggtacccagttcccggtaccccgttcccccgtcggtcccccgtacccgttccggtcccgtaaccccggagggtacccgtacccgtaacccgttaccccgggaacggtaccgacccggtaccgacccgggg

SEQ ID NO: 72190 - DNA, 732 bp, Homo sapiens
  misc_feature: GYAE6OF02IM0TR.21.26.C04.1.454.CMB.1.raw
  modified_base (251)..(251): a, c, t, g, unknown or other
  misc_feature (251)..(251): n is a, c, g, or t
tcagtcgtcgctcgcacgaccggtgctcgatttagtctagcgactttgggtttggggggaagaggaagactgacggtcctgctgctgaccatccttcatgggtcttgtcccagatcaccttgaaggagtctggtcccagctggtgaaacccacagacgaccctgacgctgacctgcaccttctctggttttccactcagtaccactgcaggtggtgtcggctggatccgtcacggcccccggaaggcccgngtggtctcgcactcattgtaggatgatgactaaccacgtacacgcctatcgtcgtacggacggaccgtacggtcctaccgtaccctcgaaccggtaacggacacccggtaacaaaaccggtggtaccgtacctaacgacgtaacgaaccgtactacgtaccggaaccctagtaccggaacgtaccgacgacctacctacgttaccgtacgtcgcgtacgacggtaacgggtacgtcggtacgtacggggtcgtaacgggtccgttacggtccgggtaccgtacgggttaccgtacccggttcggtacccgtaccgttcgttacccgttacggaccgtaccccggtaccgacccggttaaccgggtaccctaccggttaccgggttacccctacccgggtacggtccccggtcgtacccggtccgtaccggtacgtaccgtacccgtccgtaccggtaacggccgtacccgaggtacccggg

SEQ ID NO: 72191 - DNA, 684 bp, Homo sapiens
  misc_feature: GYAE6OF02FF2IM.21.26.C04.1.454.CMB.1.raw
  modified_base (356)..(356): a, c, t, g, unknown or other
  misc_feature (356)..(356): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacggccccccggaaaggccccggagtggcttgcactcatttatggaatgatgataaccactacagccatctctgacggaccaggcctcaccctcaacgaacggaccaccgaaccaaaaaccgnggtacggtacctaacactagaaccaacacgtacggaacccctagtcggaacacacgaccaactactaactactgtgaccacgagggtactcggcgtggggtcgtagggacgttacggtcggggacccaggggtaccgtccgttgggtacccgtaccgtcctacccttacgaccgtcccgtacccgtaaaccgaaccggggtcccctacgttaccccgggttcccgttccccccgtaggggtcccccgtaccccggtcgtaccccgttacccggacgggtaaccgaccctacccggtacccgacggtaaccggcccgtaacgtcccggg

SEQ ID NO: 72192 - DNA, 692 bp, Homo sapiens
  misc_feature: GYAE6OF02JZ3SA.21.26.C04.1.454.CMB.1.raw
  modified_base (386)..(386): a, c, t, g, unknown or other
  misc_feature (386)..(386): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacgacccccggaaaggccccggagtgcttgcactctatttattggaatgatgaactaaccgactaacagcccatctctggacggaccaggctccacctacacggaacgaccaccgaaccaaacctaggtacggtacctaacacgtacgaaccaanactgaaccccagtacgacacgagtacccaacgtactaacgtactacgtacgtaccaacggaccggggaagtcgggtacggttacggggtacgggtacgggtaaccgtacgggtaccggggacccggtaacgggtaccggtccgttacggtcccgtaaccgttaccgtcccgttacgtacccgacctacccgaaacccgacgggtaccccaacggttcccgtcccgttccccgtacggtcccgtcccgtacgtccctaccgtaccggacgtaccgaccgtaccggtacgacgtccgaccgtaccggg

SEQ ID NO: 72193 - DNA, 637 bp, Homo sapiens
  misc_feature: GYAE6OF02JGXOD.21.26.C04.1.454.CMB.1.raw
  modified_base (362)..(362): a, c, t, g, unknown or other
  misc_feature (362)..(362): n is a, c, g, or t
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcatcagtaccactgcagtgggtgtgggctggatccgtcacgaccccccggaaaggccccggagtcggcttgcactctattttagttggaatgatgaactaaccactacacgcccatctctgagaccaggcctccaccctgaacgaggaccacccggaaccaaaaccgnggtacggtacctaacacgtacgaaccaacacgtaccggacccagtcgaacacgacnccacatactctgtcgcacgacgggtgagngtagggtgacgggtactcggtcggggaccagggtccgtcgtcgggacctccggttactcccgtacgaccgtaccctccgaaccgtaccgggccctaacgttcccgttcccgttccccggtagcccggtccgacgtccctaaccgacggacgtccgacccgttaccggaaggcggtacccacgtacccggg

SEQ ID NO: 72194 - DNA, 684 bp, Homo sapiens
  misc_feature: GYAE6OF02H6BCW.21.26.C04.1.454.CMB.1.raw
  modified_base (274)..(274): a, c, t, g, unknown or other
  misc_feature (274)..(274): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctgggtcccacgctggtgaaacccacagagaccctcacgctgacctgcaccttctctgggttttcactcagtaccactgcaggtgggtgtgggctggactccgtcacgcccccgggaaaggccccggagtcggcttcgctactntactttattggaatgatgaataaccactacacgccatcctactcgacgaccgaggcctcaccctacgacgtaacggaaccaccgaaacccaaaaaccgtggtacggtaacctaaccacgtacgaaccaacagtaccggaacccctagtacgacctacacggtcccaacaacttaacctacgtgtacgccaacggacgggagtcggcggtagggtcggtggactacgggtcggacgagggtctaccgtggtacccgtacgttcctacctcgacgtaccctaccgacccggtaaccggccctaccggttcccgttcccttaccccggtcggtcccgtcccttcggacccgtacccggtaccgaccggtacccacccggttacccggacgacgtaccccgacgtaccccgggg

SEQ ID NO: 72195 - DNA, 778 bp, Homo sapiens
  misc_feature: GYAE6OF02IOQVM.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtttgggctggatccgtcacgacccccggaagcccggagtcggcttgcactctatttagtggatgatgactaaccactacagcccatctcgtagacggtaccacggctccaccctaccaacggaacggaccaacccgaaccaaaaccgtcggtacggtaccctaacgactacgaacccaacgacgtaccggaccccagtacggaccaaccacgacccgaacaacttaacctacgtagtacgacaaccggacgggtacgtagggtccggtaggggtacggtacgggaccggtaccggtacgggggacccgtaacgggggtaccgttcccgggtacggtacccgtaacccggttcccgtcccgtaccgtaacccggtccccttaaccccggaacccggtaaccgggtaccccgtacggtttaccccccgggtttccccgtttaccccccggtccgggaccccgttcccccggttaacggaccccgtacccggtaagggacccggtacccgtacccccgtaccgggacggaacccgtacccgaccggtacccgggtacccccgggg

SEQ ID NO: 72196 - DNA, 674 bp, Homo sapiens
  misc_feature: GYAE6OF02HT7S8.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctgacctgcaccttctcgttgggttttcactcagtaccactgcagtgggtggtgggctggactccgtcaccggcccccggaaaggccccggagtcggcttgcactctatttagttggaatgatgaactaaccactacacgccatctctacggacggaccacgggcctccaccctacgaaccggaaacggacccaaccgaaacccaaaaaccggcggtacggtaccctaaacgactacgaaccaacgagtaccggacccagtacggaaccaccgacgaccacaactaccttactgtcgacaaccggacgggagtcggcggttgggtacgtcgggtaacctcgggtacgggacgacgggtactcgtcggtaccgtaccgtcctaccgcgtacgcctacccgaacggacggccctacgttccgttacccgttccccgtaggccccgtccgtacgtccgtaccgacggccgacccgtaccggaccgagaccgtaccgacgtacccgggg

SEQ ID NO: 72197 - DNA, 750 bp, Homo sapiens
  misc_feature: GYAE6OF02GJ888.21.26.C04.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagtctagcgactttgggtttgggggggtaaggaggaagtactgacggtcctgctgctgaccatcccttcatgggtcttgtcccagatcacctttgaaggagtcttggtcccacgcctggtgaaacccacagagaccctcaacgctcgacctgcaccttctctgggttttcactcacgtaccacgtgcagtgggtgtgggctggatccgtcacgccccccggaaggccccggagtggcttgccactcatttgttggaactgacttgaactaaccactacgagccctatcctctgacggaccaggctcaccctcgacggaacgggaccaaccgaccaaaaaccgnggtacggtaccgtaaaccacgtacggaaccaaactagtaccggaccccagtccggtacaccgtacgccccaactactaactacgtgtacgcctacgacgggtacggtggaccgtggggtacggtcgggaccttaacgggttcggggacccgaaggggtaccgttccgtacgggttacccgtacccgggtttcccttaccccgttacgacccgggtaccccttaccccggaaaaccccggtaaacgggggtccccctaaacgttcccggggtttcccgttacccccccgttgggaccccggttcccccgttcggacccttacccgaacgggaccgtcccgacccgttccggaaccggacgccgaacccggaccgg

SEQ ID NO: 72198 - DNA, 783 bp, Homo sapiens
  misc_feature: GYAE6OF02HO9KS.21.26.C04.1.454.CMB.1.raw
  modified_base (765)..(765): a, c, t, g, unknown or other
  misc_feature (765)..(765): n is a, c, g, or t
tcagtcgtcgctcgcacgaccggtgctcgatttagtctagcgactttgggtttgggggaaggaggaagactgacggtcctgctgctgaccatcccttcatgggtcttgtcccagatcaccttgaaggagtctggtcccacgctggtgaaacccacagagacccctcacgctgacctgcaccttctccttgggtttccactcagtaccactgcaggtggtggtgggctggactccgtcgaccggaccccccggaaaggccccgggtagtcgggcttcgcacgtactagtttagttggaatgagtagtaactaaccaactaccagccccatcctacgtacgacggaccgaacggcctaccacccctacgaaccggaaacggaaccaacccgacccaaaaaaccgcgggttacgtaaccgaaacctaccgtacgaaaccaacgacgtaccggtaaaccccagtacggaacaccacgacccacgaacttacctacgttacgtcgaccaaccggacgggtaacggtcgggtccgttagggggtcgggttaggtaccggttaacggtccgggggtaacgacggggttaccgggtacccgttgggttaacccggtcccggttacccgttccctacgtacccgggcctaaccccgtaacggaaccccgggccgtaacgttcccggttacccctccccggttaccgaccgggtcccgtacgttacccggccgtaaccgggccgtacccgtaccccggtacccgtaccgggaacncccgtacgaaccccgggg

SEQ ID NO: 72199 - DNA, 630 bp, Homo sapiens
  misc_feature: GYAE6OF02GAHYD.21.26.C04.1.454.CMB.1.raw
tcagtcgtcgctcgcacgaccggtgctcgatttagtctagcgactttgggtttggggggaagaggaagactgacggtcctgctgctgaccatccccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatggaatgatgataaccactacagcccatctctgaggaccaggctcaccctcacgaaggacacccgaccaaaaaccgaggtacggtacctaaacactacgaaccaaacactcggaccccatcggacacagccacactactactcgtgcaacgacgggagtcggctggggtgtcgggaactacggtggggccaggggactcccgtggtccaccggtcctccgtcgacgccttaccccgaaccgaaacggccccgaagttcccggttcccgttacccccgtgggccccgtcccgttcggccctacccggagggaaccgtcccgtaacccgtccgaacggtacgacccgacaacccgggg

SEQ ID NO: 72200 - DNA, 702 bp, Homo sapiens
  misc_feature: GYAE6OF02FJHK1.21.26.C04.1.454.CMB.1.raw
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
  modified_base (612)..(612): a, c, t, g, unknown or other
  misc_feature (612)..(612): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcacggaccccccggaaaggccccggagtggcttgccactcatttattggaatgatgataaccactacacgcccatctctgaggaccaggcctccaccctcgacgaaggaccaacccgaaccaaaaaccgnggtacggtaccctaaactaccgtacgaacccaanacgtacggaaccccagtcggaacacacgacccaacgtacttactacgtcgtacgaccaacggacgggtagtcggcggtgggtcggagggactacggtggggacccgtaggggtacgtcccgttaggtccgtacccgttcgtccgtaccgtaccgtcccgtaccgaacccggaaaccgggtcccctaacgttccccgggttaccctttccccccgngggccccgtaccccgttcgacccgttaccccggacgggtaaccgcccgttacccgtacccggaacggaccgtaccctacggaccccgggg

SEQ ID NO: 72201 - DNA, 605 bp, Homo sapiens
  misc_feature: GYAE6OF02FOZW4.21.26.C04.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcaacgaaggacaaccgaccaaaaaccnggtacgtcctaacactagaccaaacactacgggaccccagtggaacacacgccaacactactactgtgcaacacgggtagtggcgtggggtgtcgggactacgtcggggccaggggtacgtcctcggtcctacccggtcctcctcgacgccctcccgaccgaacgggcccacgttcccggtccctcccccgtaggccgccccgtggccctccgacggtacgccgtacccgtaccggagaccgacgaccgtaccgg

SEQ ID NO: 72202 - DNA, 789 bp, Homo sapiens
  misc_feature: GYAE6OF02JM3DI.21.26.C04.1.454.CMB.1.raw
  modified_base (276)..(276): a, c, t, g, unknown or other
  misc_feature (276)..(276): n is a, c, g, or t
  modified_base (388)..(388): a, c, t, g, unknown or other
  misc_feature (388)..(388): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcaggtgggtgtgggctggactccgtcacgcccccggaaagcccggagtgctgcactctattactgaagngtatcgaactaccgaactacgacgtcccatccgtcgtacggaggacccagggcctcccgaaccccttacgaccggaaacggaacccgaacccgaaacccgtaaaaaacccgnggggtttaacggtaccccttaaaccaaccgttacgaaacccctaaaaactcgtacccgggtaaacccccacgttacggaaccgaacccgaacgaccctaaacgtaaacttaccgtaacttacggttacgaccggtaaccgtaacggggagtacgggtaccggtggggttaccgtacggggtaaccgttacgggtaccggggtaccgggaacgggttaccgttcccggtacggttcccgtaacccggttccttaccgaccggtacgacccctcccgtaaacccgaaccgggtcccgacgttaacccggtccctttacccccgggcgtcccggtcccgtcccgcgaacccggtaacggcccgtaccgtacccggtacccgacggacgaaccgcggtacccggg

SEQ ID NO: 72203 - DNA, 886 bp, Homo sapiens
  misc_feature: GYAE6OF02GHM6Q.21.26.C04.1.454.CMB.1.raw
  modified_base (157)..(157): a, c, t, g, unknown or other
  misc_feature (157)..(157): n is a, c, g, or t
  modified_base (797)..(797): a, c, t, g, unknown or other
  misc_feature (797)..(797): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaccgaccanagaccgtcctacgctcgtaccgtacgcgaccttccttcgttcgggtttttcggttacctacctacgtaccgtacctacgtcgacgtggggttgggtggggtcggtcggtacggtccgttcccgaccggaccccccgggaaaccccgggaaccccggggaccgggtcgggtccgttcggtccgaccttaccgttacttttaagtttagggaagtacgtacgtagtaaccttaaaccaaccttaccgaacgccccgtacttaccttcgttacgggacgggaaccccgacggccgttcccaaccccgtaccgaacgggaaaccggaaccgaacccccgaaacccgtaaaaaacccggtaagggttccgggttaacctaaaccccgtaaccgacgtaaccgaaacccacgttaccggacccccgactagggaaccaccgaacgaccaacctaattaccgttaccgtcgtaggcccaacggaacggggtgggttagccgggttaggggttcggtagggaccgttaacgggtcggggaccggagggtacgttccgttacggtacctacccggttcgtaccctccggaacgtcccctacccgaaccgtaaccgggcccgtccgttaccggttccccgtttcccccgngggtccccgtccgtcccggttacctcccgggaggaaccggtccccttaacccgtcccgggaacggaccggtacccacccggacccgggg

SEQ ID NO: 72204 - DNA, 672 bp, Homo sapiens
  misc_feature: GYAE6OF02IGRV6.21.26.C04.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcacctttctctgggttttcactcagtaccactgcagtgggtgtgggctggatccgtcacgcccccggaaaggccccggagtggcttgcactctatttataggaattgatgaataaccactacacgacccatctactgaacggaccgaggtccaccnccctacgaacgaacgaccaacccgaaccaaaaaccgaggtacgtacctaaaccgactacgaaccaacacgtaccgaaccccgtagtacgaccaacacgacccacacttaactacgtagtcgaaccacgaacgggagtggacgtgggtcgtgggtaactacgggtcggggaccgtagggacttccgtacggtccctacggttcctaccgttcgaccgtccctacccgaaccgaaccgggtcccacgttcccgtacccgttccccgtcggaccgtccccgtacgccgtaccgaacggaccgtacccgaacccgtccggaagtaaccgccgaaccgtccggg

SEQ ID NO: 72205 - DNA, 663 bp, Homo sapiens
  misc_feature: GYAE6OF02GL8J4.21.26.C04.1.454.CMB.1.raw
  modified_base (345)..(345): a, c, t, g, unknown or other
  misc_feature (345)..(345): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggctgcactcatttatggaatgatgataaccactacagcccatctctgacgaccagctcacctcacgacggacaccgaccaaaaccgnggtacgtacctaacactcgaaccaacacgtacggacccctagtacggaaccaacacgacccaacaactaactacgtgtacgacacgacgggacgtcggcgtaggggtggtacgggtacctacggtcgggacccgaggggtacgtccgtacggtccacccgttcctccgttccgacgtaccctcccgaaccgaacgggtccccaacgttcccggttaccccgttccccgtcgggtacccgccccggttaccgcccgtacccgaccgggaccgtaccctacccggtacccggaacggacccgtacccgtaccgacccggg

SEQ ID NO: 72206 - DNA, 683 bp, Homo sapiens
  misc_feature: GYAE6OF02FO17D.21.26.C04.1.454.CMB.1.raw
  modified_base (586)..(586): a, c, t, g, unknown or other
  misc_feature (586)..(586): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcgacgccccccggaaacgggccccggaggtcggcttgcactctatttatggaatgatgaataaccactacacgcccatctctgaggaccaggctcaccctcacgaacgaccaccgaaccaaaaccgacggtggtaccaacactcgaaccaacactacggacccaagtcggacacacgaccaactactactacgtgtagaccacgacgggagtcgggccggttggggtggtcgggacttacggtacggggtccgaagggtcgtcgtcggtacctacccggtctcccgtaccgacgtaccctaccgaaacccggtaccgggacccacggtttacccgggttcccctttacccccggngtcccccggtacccgtccggtaccccttaccgggacggtaccggtaccccgtaaccccgtaccgggaccggaccgaccgtaacccggtaacccgggg

SEQ ID NO: 72207 - DNA, 683 bp, Homo sapiens
  misc_feature: GYAE6OF02HOIAB.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactcgcaggtgggtgtgggctggatccgtcacgcccccggaaaggccccgagtcggcttgcactcatttatggaatgatgactaaccactacagcccatcctctggacggaccaggcctccaccctcacggaacgaccaacccgaccaaaaccgaggtacgtaccctaaacaacctacgaaccaacacttacggaaccccctatcgggaaccacaacggcccaacgaacttactacctgtacgtacacgacgggagtcggacgttggggtcggtcgggaccgttaggtcggggacgagggtacgtcgtaggtccgacccgtcctccgtcgacgaccctaccgaaccgaaccgggccctacgttccggtacccctttccccgggtccggtaccccggtcccctccggtacccgtacccgtaccgggtccgtacccgttcccggtaacccggaccggtaaccgcccgtaaccggacccggg

SEQ ID NO: 72208 - DNA, 902 bp, Homo sapiens
  misc_feature: GYAE6OF02G9OIE.21.26.C04.1.454.CMB.1.raw
tcagtcgtcgctcgcacgaccggtgctcgatttagtctagcgactttgggtttgggggaagaggaagactgacggtcctgctgctgaccatcccttcatggtcttgtcccagatcaccttgaaggagtctggtcccacgctggtgaaacccacagacgaccctcacgctgacctgctaccttctcgttggttttcactcagtaccacgtgcagtgggtgtgggctggacgtccgtcgaccggaccccccggaaacggccccggagtcggtcttcgaccactactattttagttaggaattgagtagaactaaccacttaccacgccctatctcgtacggacggtaaccacggtacctccaaccccttacgaaccggaaacggacccaaccccggaacccaaaaaccgtacgggttacggtaacccctaaacgtacctacgaaaccccaaacgtaaccgtacccggtaaaccccgtacgtaaccggtaaaccgaaccgaaccgaaacccaactacgtttaaccgttaacgttcgtaccgtaaccgaacggtaacggggtacggttccggggttagggttaccgggggtcgggttaccggggtaaaccgttaccgggtacgggggtacccgggtaacggggtaacccggttacccggtttaccgggacccgtttacccgttcccgttcccgtacccgtaacccgggtcccctttaacccggaaccccgggtaacccgggtaaccccgtaccgggttaccccggtttaccccccgttcccccggttcccgggtccccggtaaccccggttcccggtacccccgttaaccgggtaacccggtacccgtaccccggttaccccgcccggggttacccggaaccggtaccgaccccggtaaccccggg

SEQ ID NO: 72209 - DNA, 590 bp, Homo sapiens
  misc_feature: GYAE6OF02F3SN6.21.26.C04.1.454.CMB.1.raw
  modified_base (432)..(432): a, c, t, g, unknown or other
  misc_feature (432)..(432): n is a, c, g, or t
  modified_base (535)..(535): a, c, t, g, unknown or other
  misc_feature (535)..(535): n is a, c, g, or t
  modified_base (558)..(558): a, c, t, g, unknown or other
  misc_feature (558)..(558): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcacgcccccggaaacggccccggagtggcttgcactcatttatggaatgatgataaccactacagcccatctctgaggaccaggctccacctcacgaagaccaccgaccaaaaccaggtcgtacctaacactacaaccaacactacggaccccagtcggaacacacgacccactaactactactcgtgacacgaacgggngtcggcgtgggtcggtagggacttacggcggggacgagggacgtccgtggtccaccgtctcctcgacgcctccaccgaacggcccacgtccgtccttccccgngcccgcctcgcctccgacggacnccgacccgtaccgagacgtaccacgtacccgg

SEQ ID NO: 72210 - DNA, 652 bp, Homo sapiens
  misc_feature: GYAE6OF02IMXZ3.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcaggtgggtgtgggctggatccgtcacgccccccggaaaggccccgagtggcttgcactcatttattggaatgatgaactaaccactacacgcccatcctctggacggaccaggcctccaccctacgaacggaagaaccacccgaaccaaaaccgtggtacggtacctaacacctacgaaccaactacgtaccggaacccctagtacggaaccaaccgtacgacccaacctactaacctacgtagtacgacgaacggacgggtagtcgggtcgtggggtcggtacgggacgtacgggtcggggacgacgggtacgtccgtcggtccgaccgttcctcctaccgacgaccctaccgaccgacggccctacgttccgtcccgttcccgtcggcccgtccgtcgccaccgacgaccgtccgaccgtacgaccgacgcgacggaccgg

SEQ ID NO: 72211 - DNA, 755 bp, Homo sapiens
  misc_feature: GYAE6OF02JTD1V.21.26.C04.1.454.CMB.1.raw
  modified_base (492)..(492): a, c, t, g, unknown or other
  misc_feature (492)..(492): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacgcccccggaaggcccggagtggcttgcactctatttattggaatgatgactaaccactacagccctatctctagacggaccacggcctaccaccctcgaacggaacggaccacccgaaccgaaaaaccgtggtacggtacctaacacgtacgaaccaactactacgggtaaccccagtacggaacctaacgaacgacccaacacgtaactacctacggtacgcccgaacggaacggggtacggtgggccggtttggggngggttaaccgggaaccgttacgggttaccgggggccggaacgggggtaccgtcccggttacgggtaccccgttaacccggttccttaccccggtccgtaacccgcccgtacccccggtaaaccgaacccggggacccctacgttaccccgggttcccccttcccccgggttcgggtcccccgtaccgttccggccctaccccggtaagggacccgtcccgtaccccggtccggaaccggtacccgaccgacccgtacccgggg

SEQ ID NO: 72212 - DNA, 691 bp, Homo sapiens
  misc_feature: GYAE6OF02GHMBU.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacggaccccccggaaaggccccggagtggcttgcactcattttatggaatgatgaataaccactacacgcctatctctggaacgaccaggtctccaccctcaacggaacggaccaaccgaaccaaaaaccgacggtacggtacctaacgacctacgaaccaactacgtcggaacccagtacgaacaacacgaccaactactaacctacgtagtgaccgaacgacgggtacgtcgggcgtaggggtagtcggggtaacgtaggttcggggaccgtagggtacgtccgtggtccctacgttcctaccgccgtacgaccctaccgaaccggaaccgggtcccctacggttcccgggttccccttaccccggtccgggacccgtccccggtaccgtacccgtacccggtacggacccgtacccgtacccggtaccggaacgacggacccgaccgtacccgggg

SEQ ID NO: 72213 - DNA, 784 bp, Homo sapiens
  misc_feature: GYAE6OF02HLLMG.21.26.C04.1.454.CMB.1.raw
  modified_base (128)..(128): a, c, t, g, unknown or other
  misc_feature (128)..(128): n is a, c, g, or t
  modified_base (749)..(749): a, c, t, g, unknown or other
  misc_feature (749)..(749): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggngtctggtcccacgctggtgaaacccacagagaccctcacgctgacctgcaccttctctgggttttcactcagtaccactgcaggtgggtgtgggctggactccgtcgaccggaccccccggaaacggccccggagtcggcttcgcactctagttttagttggaatgatacgtaactaaccactacacgcccctattcctacgtacggacggaccgtaacggtcctacccgaacccctacgaaccggaaacggaacccaaacccgaaacccgtaaaaaccggcggggttaccggttaaccctaaactaccgtaaccgaaacccaacgtaacgtacccggtaacccctacgtacggaaccaaccgtaaccgacccgtaaacctaaacgtttaaccgttaacgtcggttacgacccgtaacggaacggggtacggttcgggtacgggttggggttacggtacggggttaaccgtacgggtcggggtaccgtaacggggtaccgttcccggtacggtcccgtaccgttccctaccgtccaccgtcccctaccgaaccgtaccgggcccacggttcccgtcccgttcccggcggtcccgtcccgtccgtaccgaccgtacggaccncccgtaccgtcgaaccgacgaccgacccgtccggg

SEQ ID NO: 72214 - DNA, 697 bp, Homo sapiens
  misc_feature: GYAE6OF02FJQX5.21.26.C04.1.454.CMB.1.raw
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggactccgtcacgccccccggaaaggccccggagtcggcttgcactctatttatggaatgatagactaaccactacacacccatctcgtaggacggaccgaggcctaccaccctacaacggaacggaccaccgaaccaaaaccgnggtacggtacctaaacnctacgaaccaacacgtaccggaaccccagtacggaacctacacgacccaactactaacgtactcgtacgaccgaacggacgggaggtcggtacggtggggtcggtacgggtaactacgggtacggggaccgagggtaccgttccgtcggtacccgtaccggtcctacctacgtacccgaccgtacccgtaaccgaccggtcccgacgttcccggttcccgttcccccgcgggtcccgtccccgtactcccggtaccggtacggaccgtaccgacccgtccggaacgtaccggaccgtaccggtacccggg

SEQ ID NO: 72215 - DNA, 652 bp, Homo sapiens
  misc_feature: GYAE6OF02F6J5W.21.26.C04.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggntggatccgtcacggccccccggaaaggccccggagtcggcttgcactctatttatggaatgatgataaccactacagcccatctcgtgacggaccaggcctccaccctacaacggaacgaccaaccgaaccaaaaaccgaggtacgtacctaaaccactacgaaccaacagtaccggaaccccgtagtacggaaccacacggcccaaacactaactactgacgaccgacgaaccgggaggtggcgtgggggtagtacgggtaacctacggtacggggccgaaggggtacgtaccgtcggtaccacccgttacctccgtaccacgacccttcccgaacccgaacggccctagtcccgttcccgttccccgcggacccgtcccgtgccctacgacggcgacctaccgtaccgagtacgaccgacgaccggg

SEQ ID NO: 72216 - DNA, 811 bp, Homo sapiens
  misc_feature: GYAE6OF02IWB8K.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcgttgggtttcactcgagtaccacgtgcaggtgggtgtgggctggactccgtcgaccggacccccccgggaaacggccccggtaggtcggtcttggccactactatttattggtaacgtgatgtaataacccaactaccacgaccccatctccgtggaacgggacccagggtcccttacccaccccgtcctaaccgggaaacggtacccaaccccgaacccaaaaaccgtagggtccgggtaaccctaaactacctaccgaaccctaaacgacgttaccgggacccccagtacgggaaccaccgaacgacccaacctactaacccttacgtacggtacgaccgaacgtaacgggggtacggtcgggacggttcgggggttacggtacggggtaccgtacgggttaccggggtcccgggtaacggggtcggttccgggtaccgggtccgtaacccgtccgttacccgtacgtccgtacccgtacccgaacccggtaaccggacccttaccgtacccggttccccgtttccccgtaccgggtccccgtccccgtacggcccgttacccggacgggtacctaccccgtcccggttaacccggacggaccgtacccgaaccggtcccggg

SEQ ID NO: 72217 - DNA, 604 bp, Homo sapiens
  misc_feature: GYAE6OF02G2OLR.21.26.C04.1.454.CMB.1.raw
  modified_base (548)..(548): a, c, t, g, unknown or other
  misc_feature (548)..(548): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttattggaatgatgataaccactacagccatctctgacggaccaggctcaccctcacgaggacacccgaccaaaaccaggtcggtcctaacactagaaccaacacgtacggaccccatcggacacacgaccacactactactgtcgcacgacgggagtcggcgtggggtgtcgggacttacggtcggggaccgagggtacgttccgtggtcctacccgtctcccgtcacgtccctaccgaccgaacgggtcccctaacgtcccggttcccttccccgnggcccgcccgtcgcctccgacggacgtccacccgtccggacgacgccacgacccgg

SEQ ID NO: 72218 - DNA, 735 bp, Homo sapiens
  misc_feature: GYAE6OF02H4UH1.21.26.C04.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccagctggtgaacccacagagaccctcacgctgacctgacctaccttctcgttggtttcactcacgtaccactgacgaggtgggtgtgggctggactccgtcgaccggacccccggaaggccccggtagtcggtcttcgcgacctctagtttacgtggaactgtatacggtaactaaccgactacgacnccgtatctacgtacgacggaccacggcctaccgaccctacgaaccggaacgaacccgacccgaaacctaaaccggtcggttaccgtaaccgtaaaccacgtaacccgaaaccctaaacgtaccgttacccgaaacccgtagtaccggacctaacgaccgaccaaacttaccgttacgtactcggtacgaccgaacgggtaacgggaggttacggtcggtagggtaggtaccgggtaccgtaacgggtcgggtaacccgagggttaccgttccggtacgtacccgtacgttcctaccgtaccgccgtaccacccgtacgaccgcctaaccgtccgttaccctccgtacgcccgtccgtaccgtccgaacgaccgtaccgccgttaccgcgtaaccgcgacgaccgtaccggg

SEQ ID NO: 72219 - DNA, 681 bp, Homo sapiens
  misc_feature: GYAE6OF02H9RBZ.21.26.C04.1.454.CMB.1.raw
  modified_base (436)..(436): a, c, t, g, unknown or other
  misc_feature (436)..(436): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtgggctggatccgtcacgcccccggaaaggccccggagtggcttgcactctattttagttggaatgatgaactaaccactacacgcccaatcctctggaacggaccagggcctaccaccctacgaacgaacgaccaacccgaaccaaaaaccgaggtacggtacctaaaccactacgaaccaacgactacggacccctagacggaccaacacgacccaanacttaactactgtacgaccgacgacgggagtcggcgttggggtacgtcgggaacgttacggacgggtaccgaggggacgttccgtcggtacctacccgtcctcccgtcgtaccgaccctacccgaacccgaacggggccctaacgttccggttacccgttcccccgtcgggtcccgcccgtaccgtcccgtcccgaaccggccgaccgacccgtaccggaccggtacgacccgaccgtacccggg

SEQ ID NO: 72220 - DNA, 627 bp, Homo sapiens
  misc_feature: GYAE6OF02IZEMY.21.26.C04.1.454.CMB.1.raw
  modified_base (573)..(573): a, c, t, g, unknown or other
  misc_feature (573)..(573): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggatccgtcacgcccccggaaggcccggagtggctgcactctatttatggaatgatgactaaccactacacgcccatctcgtggacggaccaggtcctccgaccctacgaaccggaacggaccacccgaacctaaaaccgacggttaccgtacctaaacgacctacgaaccaaacgtacacggaacccccagtacgacacacgaccaacctatacctacgtcgtacgaccgacgacgggtagtaggtcggtgggttggtacgggacctcggtcggggaccgagggtcgtcccgtgtaccgtaccgtctaccgtcacgtcctcaccgacgcctacgtcgtaccctcccgngccgtccgtcgtcctacgacggtccaccgtaccgtccgacgaccgcacgtccgg

SEQ ID NO: 72221 - DNA, 785 bp, Homo sapiens
  misc_feature: GYAE6OF02IC19J.21.26.C04.1.454.CMB.1.raw
  modified_base (225)..(225): a, c, t, g, unknown or other
  misc_feature (225)..(225): n is a, c, g, or t
  modified_base (769)..(769): a, c, t, g, unknown or other
  misc_feature (769)..(769): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccacagacgaccctcacgctgacctgcaccttctctgggttttcactcagtaccactgcaggtgggtggcggntggactccgtcgaccggaccccccgggaaaggccccgggagtcggtcgttcgctacctcttaattttacgtaggtaatgaatcgaactaaccactacgaccgtcccattctacgtagaccgaccgtacggcctaccgaccctcgaacggacggtaccaacccgaaacctaaaaccggtcggttacgtaccctaaaccgacgtacaaccccgtaaataccggtaccggaacccctaggtaccggaaacctacccgaacggaaccctactaaacgttccttactcggttaccgaacctccgggaaacggggtcgtcggggtacgttaggggtacggtacgggtaacgttacggggtccggggtaaccgagggggtacccgttccgggtacggttacccgtaaccgtcccgttaccgtaccggacccgtaccctacccggaaccgttacccgggaccttaccggttcccgttccctaccccgtgggcccctaccggttccgcctacccgggagtacccgtccctaaccgggtcccgaacggtacccnccggtaaccgcccggg

SEQ ID NO: 72222 - DNA, 688 bp, Homo sapiens
  misc_feature: GYAE6OF02HIEGW.21.26.C04.1.454.CMB.1.raw
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
  modified_base (677)..(677): a, c, t, g, unknown or other
  misc_feature (677)..(677): n is a, c, g, or t
tcagtcgtcgctcgcacgaccggtgctcgatttagtctagcgactttgggtttgggggggaagaggaagactgacggtcctgctgctgaccatcccttcactgggtcttgtcccagagtcaccttgaaggagtctggtcccacgctggtcgaaacccacagagaccctcacgctgacctgcaccttctcttgggttttccactcagtaccactggcaggtgggtgtgggctggactccgtccaccggaccccccgggaaacgggccccggagtggtcttcggctacttactattttattcggaaatgaatcgaagtaacccactacgacgcccatctcgtggacggaccagccnccaccctcgaacggaacgaccgaccgaaccaaaaccgnggtacggtacctaaacactacgaaccaactacgacggaaccccagtaggaccaacgacgacccaacgaacttactacgtacgtcgaccacgtaacgggagtacggtgtcgggtaggtacggtaacgtacggttcgggacgtacgggactccggtacggtaccgtaccgttcgtacccgtcgaccgcctacccgaaccgtaaccggacccaagttcccgtacccgtcccgtcgggccccttaccgccgtctaccgacggtcaccgttcccgtacgaccgacgtccnccgtaaccggg

SEQ ID NO: 72223 - DNA, 627 bp, Homo sapiens
  misc_feature: GYAE6OF02IT432.21.26.C04.1.454.CMB.1.raw
  modified_base (211)..(211): a, c, t, g, unknown or other
  misc_feature (211)..(211): n is a, c, g, or t
  modified_base (568)..(568): a, c, t, g, unknown or other
  misc_feature (568)..(568): n is a, c, g, or t
  modified_base (597)..(597): a, c, t, g, unknown or other
  misc_feature (597)..(597): n is a, c, g, or t
tcagtcgtcgctcgcacgaccggtgctcgatttagtctagcgactttgggtttgggggggaagaggaagactgacggtcctgctgctgaccatccctttcatgggtcttgtcccagatcaccttgaaggagtctggtcccacgctggtgaaacccacagagaccctcacgctgacctgcaccttctcttgggttttcactcagtaccactncagtgggtgtgggctggactccgtcgacgaccccccggaaacggcccggagtcggcttgcactctatttattgaatgatagaactaaccactacacgcccatctctagaggaccaggctccacctcacgaagacaccgaaccaaaacgagtacgtacctaacactacgaactaacacgtacgaacccagtacgacacacgaccacactactactgtcgacacgacgggagtacggcgtgggtgtacgggtactagggtcgggaccgagggcttccgtcggtaccaccgttcctaccgtacgaccgtaccctcccgaaacgtaaccgggtcccaacgttcccgtcccgttaccccggngtcccggcccttcggctacccgaggaccnccgtacctccgaggacgtccgaaccgcggg

SEQ ID NO: 72224 - DNA, 779 bp, Homo sapiens
  misc_feature: GYAE6OF02GED0F.21.26.C04.1.454.CMB.1.raw
  modified_base (389)..(389): a, c, t, g, unknown or other
  misc_feature (389)..(389): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctgacctgcaccttctctgggttttcactcagtaccactgcgagtgggtgtgggctggactccgtcacgccccccggaaaggccccggaggtcggcttgacactctatttacgttggaatgatgaactaaccgactacgacgcctatactctaggacggtaccgacggcctaccacccgtacgaaccggaacggaccctaaccgaaaccctaaaaaccgngggttacgtaccctaaacgactacgaacctaacgacgtacggaacccagtacggaaccacaacgtcccaacgtactaaccgtacgtacgtacgaccgtaaccgaacggggtacggttacgggtcgttacggggggttacggtaccggggtaacgttaaccgggtcggggtaacccgggtaaggggtaaccgttccggtttaccggggtaaccgtacccgtttcgtaacccgttccggaacgttacccccgtaacccgtaacccggtaaccgggaccccttaacgggttccccggttaacccgttcccccgtggtaccccggtaccctcggtacccgtaccgtacggaccgtacctaccccggtggaccgtacgccggtaaccgacccggg

SEQ ID NO: 72225 - DNA, 188 bp, Homo sapiens
  misc_feature: GYAE6OF02GX8CZ.21.26.C04.1.454.CMB.1.raw
  modified_base (143)..(143): a, c, t, g, unknown or other
  misc_feature (143)..(143): n is a, c, g, or t
  modified_base (177)..(188): a, c, t, g, unknown or other
  misc_feature (177)..(188): n is a, c, g, or t
tcagtcgtcgctcgcacgaccggtgctcgatttagtctagcgactttgggttttggggggaagaggaagactgacggccctgctccaggagcacctccgagagcacagcggccctgggctgcctggtcaaggactacttcccncgtctctactgagcgggctggcaaggcgcatagnnnnnnnnnnnn

SEQ ID NO: 72226 - DNA, 654 bp, Homo sapiens
  misc_feature: GYAE6OF02HY6F5.21.26.C04.1.454.CMB.1.raw
  modified_base (208)..(208): a, c, t, g, unknown or other
  misc_feature (208)..(208): n is a, c, g, or t
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaagagtctggtcccacgcgtggtcgaaacccacagagaccctcacgctgacctgcacttctctggttttcactcacgtaccactncaggtcggtgtaggctggactccgtcacgccccccggaagcccggagtgtcctgcactcatttattgaatgattagataaccacgtacacgaccctatctcgagtacggacccgaggctacccaccgtaccaacggaacgaccaaccgtacccaaaaaacgcggtacggtacctaaacacctacgtaaccaaacataccggtaccccagtacgacanacgacccanacctactactagtcgacacgacggngtaccggagtcgggtntacgggtaactacggtgggaccgagggtcgacgtcggcgtccgtaccgccttacgacctccgtcccgaacccgtaaacggccctagtaccggttcccttacccgtccggtccctaccctccgaccgttaccgacgttaccgcctaacccgttaccggacgtaacgcccgttagacccgg

SEQ ID NO: 72227 - DNA, 676 bp, Homo sapiens
  misc_feature: GYAE6OF02GBPX3.21.26.C04.1.454.CMB.1.raw
  modified_base (353)..(353): a, c, t, g, unknown or other
  misc_feature (353)..(353): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaagccccggagtggcttgcactctatttattggaatgatgaactaaccgactacacgcccatctctgaggaccaggctccaccctcacgaacgacacccgacaaaaccgnggtcgtacctaacactcgaccaacacgtcggaccccagtcggaccacgacgccacactactacgtgtacgacacgacggggacgtcgggacgttgggtggtacgggaactacggttcgggggacctacgggggtactacccgttcggtaccgtacccggtttacctaccgttccgaccgtccccgtaccctaacccggaacgggtcccctaacggttcccgggttccccttaccccccggtggtccccggtacccctggtacccgttacccgacgggtacacccgtaccgttaccggaacgaccggtaccaccgtacccgggg

SEQ ID NO: 72228 - DNA, 717 bp, Homo sapiens
  misc_feature: GYAE6OF02HSCEN.21.26.C04.1.454.CMB.1.raw
  modified_base (662)..(662): a, c, t, g, unknown or other
  misc_feature (662)..(662): n is a, c, g, or t
tcagtcgtcgctcgcacgaccggtgctcgatttagtctagcgacttgggtttgggggaaggaggaagacgtgacggtcctgctgctgaccatcccttcatgggtcttgtcccagatcaccttgaaggagtctggtcccacgctggtgaacccacagagaccctcacgctgacctgcaccttctcttgggttttcactcagtaccactgcaggtgggtggtgggctggatcccgtcgaccggaccccccgggaaacggcccgggagtcggtacttcggacctactacttattttagtcggtaatagatgtaactaaccacgttacacgcccatctcaggacgaccgcgactccacctagacggaacgaccgaacccgaaaccgtaaaccggtaggttccggtaaccttaacgaccgtaccggaacctaacgcgttaccggaaccccgttagacggtaaccaacgaccgtaacccgactaacttaccctacgtacgtcgaaaccgacgggtaccggggaagttcgggtacggtggggtacgtacggggtactaaccgggttcggggaccgtaagggttccgttcgtaccgtccgtaccgttccacctaccgacgtcccaaccggaccgaccggtctaccgttcccggtccctccgacggtcccncccgtgtaccctccggacgcctacccggacctacgaggtaccccgtagccccggg

SEQ ID NO: 72229 - DNA, 896 bp, Homo sapiens
  misc_feature: GYAE6OF02GOD99.21.26.C04.1.454.CMB.1.raw
tcagtcgtcgctcgcacgaccggtgctcgatttagtctagcgactttggggtttgggggggaagaggaagactgacggtcctgctgctgaccatcccttcatgggtcttgtcccagatcaccttgaaggagtctggtcccacgctggtagaaacccacagacgaccctcacgctgacctgcaccttctcgttgggttttcactcacgtaccactgcaggtgggtggtgggctggactccgtcgaccggacccccggaaaggccccggagtggtctgccactactatttagtaggaatgatgaactaaccactacgacgaccctattcctacgtacggtacggaccgacggtcctacccgaccccgtaacgaaccggaaacggaaccgaaaccccggaaacccgtaaaaaaaccggtacggggttaaccggttaacccctaaaccgaaccgtaacgaaacccaaacgtaacgttacccggaacccctaagtaccgaaacctaacgaccgaacccgaactaaccttaaccgttaaccgtacgggtaccaccggaaaccgggtaaccggggtacggttacgggtcggttagggggttcgggtaacggggtaacggttaaccggggtcgggggtaacccgggtaagggttacccggttccggtacgggttacccgtaacccgtttaccgtacccggttacccgaacccgttacccgtaccccggtaaacccggtaaacccggtccccggtaaaccgttcccgggttaccccgtttcccccgggtaccccgggtcccgtaacccccggttcccggtaacccggtacccgtaaccgggtaccgacccccgttaacccgggtacccgtaaccgggacccgtacccgggacccggtaacccggg

SEQ ID NO: 72230 - DNA, 673 bp, Homo sapiens
  misc_feature: GYAE6OF02GWKZQ.21.26.C04.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcaccttctcttgggttttcactcagtaccactgcagtgggtgtgggctggatccgtcacgcccccggaaaggccccggagtggcttgcactctatttagttggaatgatgaactaaccactacacgcccatctctagacggaccaggtcctccacctacaccgaacggaccaccgaccaaaaccgnggtacgtacctaacactacgaaccaacacgtacggaccccagtacggacaacacgaccaactactactaactcgtcgaccgacgacgggtaggtcggcgttggggtggtacgggtactacggtcggggaccgtaacggggcgtccgtcggtaccgtaccgttccgtacctccgacgtccccttaccgaaccgaaccgggacccttaaccggtcccggttaccctttcccccggcggttccccggcccgttccggacctcccggacggaccacccgtacccgtccgaaccggtacgtaccgacgacccggg

SEQ ID NO: 72231 - DNA, 633 bp, Homo sapiens
  misc_feature: GYAE6OF02G6715.21.26.C04.1.454.CMB.1.raw
  modified_base (340)..(340): a, c, t, g, unknown or other
  misc_feature (340)..(340): n is a, c, g, or t
  modified_base (398)..(398): a, c, t, g, unknown or other
  misc_feature (398)..(398): n is a, c, g, or t
  modified_base (410)..(410): a, c, t, g, unknown or other
  misc_feature (410)..(410): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtggtgggctggatccgtcacgcccccggaaggcccggagtgcttgcactcatttatggaatgatgataacactacacgccatactctggacggaccaggctcacctcacgagacacacaaacnggcgactacactcgacaacactacgacccagtgaccacgacgcaacatactacgtganacgacgacgggngtacgggtacgtggggtaggtcggaacgtacggtcggggaccgagggaacgttcgtacggtcgtaaccccgttctacccgttcgacgccgtacccaccgaaccgggaccccttacgtcccgttcccgttacccccggtcggaccccggtcccgtcggtaccctaccggacggtacccgaccgtacccggtaccggaaccggtaccggacccacggtacccggg

SEQ ID NO: 72232 - DNA, 707 bp, Homo sapiens
  misc_feature: GYAE6OF02JJ49X.21.26.C04.1.454.CMB.1.raw
  modified_base (127)..(127): a, c, t, g, unknown or other
  misc_feature (127)..(127): n is a, c, g, or t
  modified_base (216)..(216): a, c, t, g, unknown or other
  misc_feature (216)..(216): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (451)..(451): a, c, t, g, unknown or other
  misc_feature (451)..(451): n is a, c, g, or t
  modified_base (549)..(549): a, c, t, g, unknown or other
  misc_feature (549)..(549): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggngtctggtcccacgctggtgaaacccacagagaccctcacgctgacctgcaccttctctgggttttcactcagtaccactgcagtgggtntgggactggatccgtcacgtcccccccgggaaagtccccggagtcggcttgaccacttcatttattggaatgactagacgtaaccactacacgcccatcctctgacggtacccaggctaccacccgtcaacggaacggtaccaccgacccaaaaaccgngtcggtactacactcgaacaacgntaccggaccccatcggaacctaccagtacccacgtatacctactcgtgaccncgacgggtagtcggacgttgggacgtacgggtactaccggtacggggtaccgacggggtacgtcccgttggtacccgtacccgttcgtccccgttacnccggtcccgtaccgaacccggaacgggtccccaacgggttcccggttacccttacccccgtacgggccccgtccccggttacggacccgtttacccggaaccggtaccgacccgtaacccgtccccggaaacggtacgggaccctacccggtaccggg

SEQ ID NO: 72233 - DNA, 795 bp, Homo sapiens
  misc_feature: GYAE6OF02FS6HX.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgacggagtctggtcccacgctggtgaaacccacagagacctcacgctgacctgcaccttctcttgggttttcactcagtaccactgacaggtgggtggtgggctggactaccgtcacggacccccccgggaaacggccccggagtcggcttagccgactctattttataggaattgatagactaaccacctacgagccccattcctccgtagacggtaccgacggtcctaccgacccctcgtaaccgggacggaacctaacccggaaaccctaaaaccggtacgggtttacggcccttaaacgacctacggaaccaacgtacgtaccgaccccgaagtacggactaccgacgcctaactaccgtaacttacgtcgtacgtaccaacgggacgggtaacggtcgggtacgggttcggggttcggtacggggtaccttaccggggtcgggggaccggtacggggttccggtaccgggttccgggtaacccgttccccggttacccgttacccgttcccgtaacccgtccctaaccccgggtaccgtaaacccgggcccgttaaccgggttccgttcccccgttacccgggtcccgacccggtccccgcgtaccccggtcgtaaccgggccgtacccgtccggtacccggaaccggcgacccgaccggtacccggg

SEQ ID NO: 72234 - DNA, 642 bp, Homo sapiens
  misc_feature: GYAE6OF02GHQCB.21.26.C04.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagcccccggaaagcccggagtggcttgcactcattatggaatgatgataacactacagccatctctgaggaccaggcctcaccctcaacgaaggacaccgaccaaaaaccnggtacgtacctaaaccactgaaccaaacactacggaacccccagtcggaacaacacgacccaacataactactgtcgaccgaacacggggagtcggcgttggggtcgcgggtaacttaacggtcggggaccaggggacgtccgtagggtcctaccggttacctcccgttaccgacggtccctacccaaaccggaaccgggacccgtaacgttccggtccttcccccgtggcccgtcccgtacgtcccgtacccgtaacggaccgcgtacccgtaccggaacgcgtaccgactaaccggg

SEQ ID NO: 72235 - DNA, 629 bp, Homo sapiens
  misc_feature: GYAE6OF02I05DB.21.26.C04.1.454.CMB.1.raw
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactcatttatgaatgatgaataccactacagccatctctgacgacaggctaccacctcacgaagaccaccgaccaaaaccgnggtacggtacctaacgactcgaccaacnctacgaccctagcgacacacgccaacgtactacgtactacgtacacgacgacggagtcggtcgtagggtcggtaggacgttcggtcgggaccggagggtacgttccgtacggtcccgaccgttcgttccgtcgacgtcccgtaccaacccggaacgggtccctacggttcccgttacccgttcccggtcggtcccgtccccgacgtccctacggacggactacccgccgtccggtacgacgtccgacgacccggg

SEQ ID NO: 72236 - DNA, 722 bp, Homo sapiens
  misc_feature: GYAE6OF02GF3X3.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccggagtcggcttgcactctatttatggaatgtatgactaaccactacacgcccatctctacgacggaccaggtcctaccaccctacgaacggaaacggaacccaacccggaaccctaaaaaaccgtacggggttaccggtaaccctaaaccgtaccgtaacgtaacccaaacctacgtaccggaacccccgatacggaaccaaccgacgaccaactactaactacgtcgtacgacgacgtacgggagtcggtcgtaggggtcggtacgggacgtcggtacgggccgagggtacgtcgtacggtccgtaaccgtcctacccgtacgaccgtcccgtacccgtaaccggaacccgggccccgtaaccgttcccggtttaccccgttaccccgtcggtccccgtcccggtcgtacccgtaccgacggtaccgtcccgtaccgacccggacggtaccgccgtaacggtccccgg

SEQ ID NO: 72237 - DNA, 729 bp, Homo sapiens
  misc_feature: GYAE6OF02GE34V.21.26.C04.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggactccgtcaccggcccccggaaaggccccggagtcggcttcgcactctatttagtcggaatgatagaataaccactacacgcccaatcctctcgacggaccacggcctaccaccctcgaaccgaaggacccaaccgaaccgaaaaccgnggtacgtacctaacacttacgaaccaacgacgtccggaaccccagtaccgggaacaaccgacgccaacctaacgtaacctacgtcgtacgaccgaaacgcgggtaaggtcgggcgttggggttaccggtagggtaaccgttacgggtacggggaccgtaacggggtaccgttccggttacggtacccgtaccgttccgttccccgtacgtacccgttacccaccccgtaaaccgaaccgggccctaaccggttacccggttaccccgttccccgtccgggcccgtcccggtcctcccgtaccggtacggacccgtcccgaacccggtccggtaacgccgtaccgtaccgacccggg

SEQ ID NO: 72238 - DNA, 719 bp, Homo sapiens
  misc_feature: GYAE6OF02F29DK.21.26.C04.1.454.CMB.1.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaggccccggagtggcttgctactcatttatggaatgatgataaccatacagccatctctgagaccaggctcncctnacgaacgcaccgaccaaaacgnggttacgacctaacactagaaccaactagtccggaaccccagtcgaaccacgacgtacccataactaccgtacgtcgtacgacctaacgaacggggtacgtcgggacgtcgggggtacgtcggggaaccgttacggtacggggaccgttaacggggtacgttcccgttagggtaccctaacccgggtttccgtaaccccgtccgtaacggttaccccgtaccccgtaaaccggaacccggggtacccctaaggttcccccgggttccctttacccccccgtgggtacccgtcccccggtttaacggccgtttaccccggaacggtacccgtacccgtaccccggttaccgaacggacggacccgacggtacccgggg

SEQ ID NO: 72239 - DNA, 663 bp, Homo sapiens
  misc_feature: GYAE6OF02F4JYF.21.26.C04.1.454.CMB.1.raw
  modified_base (297)..(297): a, c, t, g, unknown or other
  misc_feature (297)..(297): n is a, c, g, or t
  modified_base (362)..(362): a, c, t, g, unknown or other
  misc_feature (362)..(362): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtcggcttgcactcatttatggaatgatgataaccactacncgaccatctctagacggaccgagcctaccaccctcaacggaacggaccacccgaaccaaaaccgnggtacgtacctaaacactacgaaccaacactacggaccccagtacggacacacgaccaactactactacttgacacgaacgacgggtacgtcggcgtgggtggacggtacttacgggacgggccgaggggtacctccgtcggtaccgtacccgttccgtacctccgaccgtcccgtacccgaaccgaccgggaccctcggtacccgttccctttccccgacggtcccgtcccgtcggacccttaccgaacgggcctacccggtaaccccgtacggaacgcccggtacacccggtacccggg

SEQ ID NO: 72240 - DNA, 622 bp, Homo sapiens
  misc_feature: GYAE6OF02JJXHD.21.26.C04.1.454.CMB.1.raw
  modified_base (297)..(297): a, c, t, g, unknown or other
  misc_feature (297)..(297): n is a, c, g, or t
  modified_base (444)..(444): a, c, t, g, unknown or other
  misc_feature (444)..(444): n is a, c, g, or t
  modified_base (595)..(595): a, c, t, g, unknown or other
  misc_feature (595)..(595): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgccccccggaaaggccccggagtggcttgcactcatttatggaatgatgactaaccactacngcccatctctggacgaccaggctccaccctcgacggaacgaccacccgaccaaaaaccgtggtacgtacctaacactcgaaccaactacgtaccgggaccctagcggaacacgacgaccacactaactactgcgacaacggacgggngtcggtgtgggtgtacgggacgttaccggaggggtaccaggggtacgtcgtacggtcaccgtctacctacgcctccgtaccgaaccgacggcccagtcccgttccctccccgtcgggcccgtcccgtcgtccgtccgaccggtacgacccnccgtaccggacggaccgcaccgccggg

SEQ ID NO: 72241 - DNA, 639 bp, Homo sapiens
  misc_feature: GYAE6OF02GYZ97.21.26.C04.1.454.CMB.1.raw
  modified_base (350)..(350): a, c, t, g, unknown or other
  misc_feature (350)..(350): n is a, c, g, or t
  modified_base (404)..(404): a, c, t, g, unknown or other
  misc_feature (404)..(404): n is a, c, g, or t
  modified_base (554)..(554): a, c, t, g, unknown or other
  misc_feature (554)..(554): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtcggcttgcactcatttatggatgatgataaccactacagcccatctctcgaggaccaggctcaccctcacgaacggcaccgaccaaaaaccgnggtcgtacctaacactcgaaccaacactacggaccccatcggacacagcccaanactactactgtcgcacgacgggtagtggcgtgggtcgtacggggactacggtggggaccaggggacttccgtggtccgaccgttcctcctcaccgtccctaccgaaccgaacgggtccctaacgttcccggttacccctttacccccggngggtaccccgtccccgtcgtccccggtccacgggtaccgacccgtaacccgtcccggaacgtaccggacccgtacgaccccgggg

SEQ ID NO: 72242 - DNA, 746 bp, Homo sapiens
  misc_feature: GYAE6OF02GMXW0.21.26.C04.1.454.CMB.1.raw
tcagtcgtcgctcgcacgaccggtgctcgatttagtctagcgactttgggtttgggggggaagagggaagactgacggtcctgctgctgaccatcccttcatgggtcttgtcccagatcaccttgaaggagtctggtcccacgctggtgaaacccacagagaccctcacgctgacctgccaccttctcgttgggttttcactcacgtaccactgcaggtgggtggtgggctggactccgtcaccggaccccccgggaaacggccccgggagtcggcgttcgcactctatttatggatgatgaactaaccactacacgcccatctcgtggacggaccgacggcctaccaccctacgaaccggaaacggaccaacccgaaacccgaaaaccgtagggtaccgtaccgaacacgtacgaaccaacgacgtaccggacccctagacgaccaacgaccgacctacaatacctacgtcggtacacgaaccggacgggtacgtgggtacggtggggtacggtacgggaccgtacgggtcgggaccggagggtacgtccgtcggtaccgacccgttctaccgtccaccgtcccgtacccgaaccggaaccggtccctaaccggttcccgggttacccttcccccgggtccgggtaccccggtcccccgttcggaccccgttaccggaaccggtcccggtaccccgtacccggtaacccgggaaccgtaccggacccgacccggtaccccggggg

SEQ ID NO: 72243 - DNA, 714 bp, Homo sapiens
  misc_feature: GYAE6OF02FX3VK.21.26.C04.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctgacctgcaccttctctgggttttcactcacgtaccactgcaggtgggtgtgggctggacgtccgtcgaccggaccccccggaaacgggccccgggaggtcggtacttgccacttctattttacttggaatgatagactaaccactacacgcctatctcgngacggaccgacggctccaccctacgaacgaacggaccaaccgaacccaaaaaccgtgggtacgtacctaactactacgaaccaacacgtcggaacccactcgaacacacgaccacaactacgtactcgcgacaacggacgggtgtacggtcggtaggggttggtacgggtaccggtacgggcggggtacgggtacggggacgttcggtcggttacccgacccggttccgtccctcgtaccgttcccgtacccgtaaacccgggaaccgggtacccctagtaccccgggttcccttccccgggacggtccccgtcccgtaccgtcccgtaccggtaccggacctacccgtacccgaccggtacggaccgtaccgacggcccggg

SEQ ID NO: 72244 - DNA, 628 bp, Homo sapiens
  misc_feature: GYAE6OF02G4W29.21.26.C04.1.454.CMB.1.raw
  modified_base (446)..(446): a, c, t, g, unknown or other
  misc_feature (446)..(446): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggtttcactcagtaccactgctaggtgggtgtgggctggatccgtcaccggcccccggaaacggccccggagtggcttgcactcattattggaatgatagactaaccactacacgccatctctagacggaccacggcctacaccctacgaaccgaacggacacccgaaccaaaaccgaggttacgactaacacacaaccaacactcgacccagtacgacacgacgacacgactacctactgtacgcaacgagggagtggngtgggtagcggactacggcgggcaagggcgtcgtcggtactaccgtctaccgacgacgtcccaccgtaaccgaccggacctaccgtccgggttcccctacccgtcggtccccgtccggttccgaccgtaccgacggtaccgacccgtacccgtaccggacgtaaccgaccgacgtacccggg

SEQ ID NO: 72245 - DNA, 699 bp, Homo sapiens
  misc_feature: GYAE6OF02FJ9XD.21.26.C04.1.454.CMB.1.raw
  modified_base (431)..(431): a, c, t, g, unknown or other
  misc_feature (431)..(431): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcaggtgggtgtgggctggactccgtcaccggacccccccggaaaggcccccggagtcggtcttggccactctattttatggaatgatgaacttaaccactacacgtccccattacctcgtaggacggacccgaggcctaccgacccctacgaaccggaaacggaccaacccgaacccaaaaaaccgtcgggtacggtacccctaaacgcctaacgaacccaaanacgtacggaccccatacggaacaaccgacgacccaataccttaactactacgtacgaccgacggaaccgggtagtcggtacggtgggtaggtacgggacgttacggtcgggaccgtacgggtacgtccgttcggtcccgaccgttcctccgtacaccgtcccgtaccacccgaccggtaccctcgttcccgttcccttccccgccggtcccgtcccgtcgcccgttccgacggtaccgccgtaccgtaccgagccgacgaccgtccgg

SEQ ID NO: 72246 - DNA, 673 bp, Homo sapiens
  misc_feature: GYAE6OF02FN8SD.21.26.C04.1.454.CMB.1.raw
  modified_base (198)..(198): a, c, t, g, unknown or other
  misc_feature (198)..(198): n is a, c, g, or t
  modified_base (308)..(308): a, c, t, g, unknown or other
  misc_feature (308)..(308): n is a, c, g, or t
  modified_base (318)..(318): a, c, t, g, unknown or other
  misc_feature (318)..(318): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (451)..(451): a, c, t, g, unknown or other
  misc_feature (451)..(451): n is a, c, g, or t
  modified_base (652)..(652): a, c, t, g, unknown or other
  misc_feature (652)..(652): n is a, c, g, or t
  modified_base (665)..(665): a, c, t, g, unknown or other
  misc_feature (665)..(665): n is a, c, g, or t
tcagtcgtcgctcgcacgaccggtgctcgatttagtctagcgactttgggtttgggggggaagaggaagactgacggtcctgctgctgaccatcccttcatgggtcttgtccccagatcaccttgaaggagtctggtcccacgctggtgaaacccacagacgaccctcacgctgacctgcaccttctcgtggttttcnctcacgtaccactgcaggtgggtgtgggctggactccgtcgaccgaccccccggaaaggccccggagtggcttgctactcatttatggatgatgaataacctactacacnccctatcctntaggacggaccaggcctaccaccctcgaacgaacggaccacccaaccgaaaaccgnggtacgtacctaacacgtacgaaccaanaccgtccgaccccagtcgaacacacgaccaacactaaccttcgtgtacnccgtaacgggaccgggtaggtggtacggttggggacgtacggggaccttccgggtacggggtacggaggggttaccgtcgggtcggttaacccgacggttcccgtacccgttcgaacccgccccgttaaccgaccggtacccggcctacgtcccgttccccgtcccgcggcccgtctccgacgtcgtacgacgtccctacnccgaagccgaccncgcccggg

SEQ ID NO: 72247 - DNA, 955 bp, Homo sapiens
  misc_feature: GYAE6OF02HMD5E.21.26.C04.1.454.CMB.1.raw
  modified_base (156)..(156): a, c, t, g, unknown or other
  misc_feature (156)..(156): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtagaaacccanagacgaccctcacgctgacctgctaccttctcttgggtttcactcagtaccatgctaggtgggtgtgggctgactccgtcacggcccccggaaaggccccggagtcggtctcgcactcattttacgtggtaatgatagaactaaccactacacgccctactcctacgtacgtaacggaccgtacggaccttacccgtacctaaccgaacggaaacgggtaacccgaaacccggtaaaacccgtaaaaaaccggtcgggggtttaaccggttaaaccccgttaaacctaaccggttaccggaaaacccgtaaaccgtaaccgttaccccggggaaaccccctacggttaaaccgggaaccctaaacccggaaacccggtaccccgtaaaaccgtaacgtttaaacccttaaccggttaacggttaccccgggtaaacccgtaaaccggggtaaccggggggttaacgggttaccgggggttaccggggtttaggggggttacccggttaaggggggttaaacccggttacccggggttaccggggggtaacccggtaacgggggggtttaccggttcccggtttcggtttaccccgggaaccccgtttccgttaaaccccgttcgtaaacccggttcccccgttaacccggaaacccggttaaaccggggtacccctaaccgggtttcccggtttacccggttcccccggaccgggtacccgtccccgttacggtacccgaccgttaacccgggcaccccgttaccggaccgtcgggaaccgtccggaaccgtcccgggg

SEQ ID NO: 72248 - DNA, 697 bp, Homo sapiens
  misc_feature: GYAE6OF02IRWY1.21.26.C04.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtgggctggatccgtcacgccccccggaaaggccccggagtcggcttgcactctatttatggaatgatgactaaccactacagcccatctctgacggaccgaggcctcgaccctcgacgaacggaccacccgaaccaaaaccgnggtacgtacctaacacctacgaacccaacgacgtacggaacccccagtacggaaccaacgacgaccaactaactacctacgtacgtcgaccgaaccgacggggtagtcgggtcgttgggggtcgtacggggtacgttacgggtcggggaccgaggggtaccgttaccggtcggtaccgtaccggttcctcccgttaccgaccgtcccgtacccgaacccgaaccgggtccctaacggtcccgttaccccgttccccgtcgggtccccgtcccgtaccggtccgtacccgacggtaccgtcccgacccgtaccggacggtacgaccgtaccgacccggg

SEQ ID NO: 72249 - DNA, 804 bp, Homo sapiens
  misc_feature: GYAE6OF02H1SVZ.21.26.C04.1.454.CMB.1.raw
  modified_base (411)..(411): a, c, t, g, unknown or other
  misc_feature (411)..(411): n is a, c, g, or t
  modified_base (481)..(481): a, c, t, g, unknown or other
  misc_feature (481)..(481): n is a, c, g, or t
tcagtcgtcgctcgcacgaccggtgctcgattttagtctagcgactttgggtttggggggaagaggaagactgacggtctgctgctgacatccttcatgggtcttgtcccagatcaccttgaacggagtctcggtcccacgctggtcgaaacccacaggacgaccctcacgctgacctgcctacctttctcgttgggtttttccaccttcgacgttaaccacgttcgactggttggggttggtggggtcgtgggactacccggtccgaaccggacccccgggaaacggcccgggacggttcggtcgttcgactacttcttaagttttacgttaggaattaggaacttacggaataaaccgacttacgacgtacccaattctacgtgaacgaccgtaacggcctccaacctnaaacggtaacgaccaacccgtaaccgaaaaacggtcggttaccggtacctaacaccgacgtaaccaacgngtaccggacccaggtacgactaacgacgacctaacgacttaccgtaacttgtacgtacccgaagggtaacggggtacgagggtcgttaggggttacggtacgggacgttaacgggtacggggtcggacggggttaccgtccgggttaggtacccgtacggttccttccggacgttaccgaccgttaacccgacccggtaaccgaccgttaacccgtcgtttcccaccccgggttcggtcccgtacccggtccttaccggtaccgaacccgggtacaacccgtcccggtaaccggtaccggaacttacccgggagaacccgggg

SEQ ID NO: 72250 - DNA, 653 bp, Homo sapiens
  misc_feature: GYAE6OF02GHI2U.21.26.C04.1.454.CMB.1.raw
  modified_base (384)..(384): a, c, t, g, unknown or other
  misc_feature (384)..(384): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggccccccggaaaggccccgggagtggcttgcactctatttattgaattgatgaactaaccatacagcccatctcgtgacggaccgaggctccaccctcaaccggaacggaaccaacccgaaccaaaaaccgtggtacggtacctaaacnctacgaacccaacacgtaccggaccccagtcgaacacacgaccacatactactgtcgcacgacgggagtcggcgtggggttagacgggtaactcgggtacgggaccggtaggggtacttccgtaggtacccacccgttccgtacctcgacgtaccctccgaaccgaaccgggccctcgttacccggtcccttccccggcggtacccgtcccgtctcccgtaccgacggcctaccgacccgtccgaacgaccgtaccgacggtacccggg

SEQ ID NO: 72251 - DNA, 719 bp, Homo sapiens
  misc_feature: GYAE6OF02HBSLJ.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgcccccggaaaggccccggagtggcttgcactcatttattgaatgatgataaccactacacgcccatctctggagaccaggcctaccaccctacacgaacggaccaacccgaacctaaaaaccgacggtacggttaccccaaacactacgaacccaaacactacggacccccagtacggaaccaacacgaccaacaacttactaacgtgtacgaccaacggaacgggtagttcgggacgttggggttaggtacgggaccggtaacggttcgggggaccggaacggggtcgttcccgtaggtacccggtaacccgttccttaccccgtacgtaccgtacccgtacccgtaaccccgaacgggtacccctacgggttacccggtacccgttcccccggtcgggaccccgtcccggtcggtacctacccggtacggaacccgcccggtaacccgtaccggaccggaccggtccgaaccgtacccggg

SEQ ID NO: 72252 - DNA, 752 bp, Homo sapiens
  misc_feature: GYAE6OF02GMKNA.21.26.C04.1.454.CMB.1.raw
  modified_base (267)..(267): a, c, t, g, unknown or other
  misc_feature (267)..(267): n is a, c, g, or t
  modified_base (349)..(349): a, c, t, g, unknown or other
  misc_feature (349)..(349): n is a, c, g, or t
  modified_base (382)..(382): a, c, t, g, unknown or other
  misc_feature (382)..(382): n is a, c, g, or t
  modified_base (425)..(425): a, c, t, g, unknown or other
  misc_feature (425)..(425): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccagctggtgaaacccacagagaccctcacgctgacctgcaccttctctgggttttcacgtcagtaccactgcagtgggtgtgggctgggactccgtacacggacccccggaaggccccggagtcgcgttnactactactattttagttggaatggtaataggactaaccaactacagtcccatcgtactagagaccaggtcctccgaccctnaaccgtaacgaccaacccaaccgtaaaaaccgnggttacgacctaacacgtacgaaccaacgactaccggaacccngtacggaacaacacgaccaactaactacctaagtcgtagaccaaacgggacgggtacggtcgggacggttacggggtaacgggttcgggaaaccggtttacgggacggggtaccgaaacgggggtcgttacccggccggtttaccgaaccgtttcccgtacgttaccgaccgtccccttaaccgaaccggaaaccgggtaccctacgggtttaccccgggttacccttacccccgggtggtaccccgttccccgtacggtccctaccgggacgggtcccctaacccgtacccgtacccgggaaggaccctaaggacccgtacccggg

SEQ ID NO: 72253 - DNA, 896 bp, Homo sapiens
  misc_feature: GYAE6OF02G34CY.21.26.C04.1.454.CMB.1.raw
  modified_base (840)..(840): a, c, t, g, unknown or other
  misc_feature (840)..(840): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctgggtgaaaaccccacagacgacccccctacgacgtcgtactacgtcaccttaccttcttcggtttcggttactactacgtaacctaacctcgtcacgtagggttggtggcggtacgtacgtaccgtccgtacgacccccggaaacccgggaaccggaccggtagtcgttacgtcacttctaacttaatttaggtaagtagtagtagtacgtaaaaccaacctaacgtaacgtacccaacctcgttactacgtacgggaacggaaccgtaccggtaccctaaccctacccgtaacggaaaccgaaccggaacccgaaacccccgaaaaaaccgtaaaaaccgggtgggttaacccgttaaaacccgtaaaccttaccggaaacccgtaaaaccaacgttaccggtaaccccggtaaaaccgcggttaaccgaaaccctaaacgaacccgtaaacccgtaaacttaaacccgttaaaccgtttaaccggtagtaaccccggtaacaaacccggggtaaaacggggtcgggttacgggtaaccgggttgggggttaacgggtaaccgttaacgggtaacggggttaccggacgggaaacgggttcccgtacggtaccgtacccgtacgttccgtactaacgcccgttaccaaccgtaacggtaccgaccctgttacccgtccccgtccggaccggtcccncggtactcccgaacggactcccgaaccgtcccgaaagaccgacgacaccggcccgg

SEQ ID NO: 72254 - DNA, 664 bp, Homo sapiens
  misc_feature: GYAE6OF02IV2CZ.21.26.C04.1.454.CMB.1.raw
  modified_base (62)..(62): a, c, t, g, unknown or other
  misc_feature (62)..(62): n is a, c, g, or t
  modified_base (156)..(156): a, c, t, g, unknown or other
  misc_feature (156)..(156): n is a, c, g, or t
  modified_base (447)..(447): a, c, t, g, unknown or other
  misc_feature (447)..(447): n is a, c, g, or t
  modified_base (469)..(469): a, c, t, g, unknown or other
  misc_feature (469)..(469): n is a, c, g, or t
  modified_base (555)..(555): a, c, t, g, unknown or other
  misc_feature (555)..(555): n is a, c, g, or t
tcagtcgtcgctcgcacgaccggtgctcgatttagtctagcgactttgggtttgggggaagnggaagactgacggtcctgctgctgaccatcccttcatgggtcttgtcccagatcaccttgaaggagtctaggtcccacgctggtcgaaacccanacgagaccctcacgctgacctgcaccttctctgggttttcactcagtaccactgcagtgggtgtggctggatccgtcacgacccccggaaggccccggatcggcttgcactcatttagtcgaatgagtagactaaccactaacacgacccatcctcgtacgacggtaccacggacctccctacccgtaccgaaccggtaaccggaacctacccggaaacccgtaaaacgcgggttacgtaccctaaccacgttaccggaaaccaacgactccggaacccagtacggaccanacgccaacactactactacgtnaaccaccggagggtacgtcggtacgtgggtgttacggacgtacggtcgggaccgaggtcgtccgcgtaccgccgtcctcaccgtcnccctacgaccgacggcctagccgttaccctcccgtggtcctcccgtacgccgtaaccggacggtaccgacctaccccggtacgtaccgaccgtaccgtacggtacccgg

SEQ ID NO: 72255 - DNA, 769 bp, Homo sapiens
  misc_feature: GYAE6OF02FKXCX.21.26.C04.1.454.CMB.1.raw
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggctccgtcacggccccccggaaaggccccggagtcggcttgcactctatttattggaatgatgactaaccactacagcccatctctagaggaccaggcctcaccctcacgaacggacaacccgaccaaaaacccgnggtacggacctaacactacgaacccgacaactcggaccccatacgggaactaccggaacncccaaacgtacttaaccgttacgtacgttagacctaaccgaacggggaagttacggggaccgttgggggttacgtacggggtaaccgttacggttcggggggaaccctaagggggtaaccgggttcccgttacggtccggtaaccccggtttaccgttcccctacggtaacgtacccctttaccccggaaaaccggtaacccggggaaccccgtaacgttccccgggttaccctttccccccccgggtaagggtcccccggtacccgtccggtaccccgttacccggaaaccggaccggtaccctaacccggttaccccggaggaacccggtccgaacccgtacccggg

SEQ ID NO: 72256 - DNA, 640 bp, Homo sapiens
  misc_feature: GYAE6OF02GPL4C.21.26.C04.1.454.CMB.1.raw
  modified_base (357)..(357): a, c, t, g, unknown or other
  misc_feature (357)..(357): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtggctggatccgtcacgccccccggaaaggccccggagtggcttgcactcatttatggaatgatgataaccactacacgacccatcctctggaggaccaggtcctccaccctcgaacgaaggaccaccgaccaaaaaccnggtacgtcctaacgactagaaccaacactcggaaccccagtacggacacacgaccacaactactactgtcgcacacgggagtggcgtgggtgtaggtacgtagtcgggtacgagggtagtccgtggtccaccgtcgtacctccgacgtaccctaccaaccgaacgggccctagttcccggtcccgttccccccgtagggcccgtcccctacggtccccgttcccgaaacgggaccgtccctaacccgtcccggtaacggtaccggaccgaacccgtacccggg

SEQ ID NO: 72257 - DNA, 866 bp, Homo sapiens
  misc_feature: GYAE6OF02GQV0R.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcacctttctcttgggttttcactcagtaccactgcaggtgggtgtgggctggactccgtcgaccggaccccccgggaaacgggccccgggaggtcggtccttgccactctattttattggaatggtatagaacttaaacccgaacttaaccgacgaccccctattcctacgttacggacgggacccgtacgggcccttcccaacccctaccgaaaccggaacgggaacccgaaaccccggaaacccgaaaaaacccggtcggggttaaccggttaccccaaaaccgtaacccgtaccggaaaccctaaacaacctaccgggaacccccaagtaccgggaaccaacgaaccgacccaaaccgaacgttaacccttaacgtcggtaccggaccgtaacgggaccgggggtaggtacggggttccggttagggggttccgggttaacggggtaccgtacggggtacgggggacccggtacgggggttacggttacccggtcgggtacccgttacccgtccgttcccgacgtacccgtcccgtaccccgaacccggtacccggtacccgtaccggttcccgggttccccgtttacccccggcggtacccccggccccggtttaccgacccggtaccggtaccgggacccgtaccccgtaaccggtcccgaacggtccgaccgaccgacccgggg

SEQ ID NO: 72258 - DNA, 909 bp, Homo sapiens
  misc_feature: GYAE6OF02FY06D.21.26.C04.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtcgaaacccacagacgaccctcacgctgacctgcacctttctcttgggttttcactcacgtaccactgctagtgggtgtcgggctggactccgtcaccggacccccggaacggccccggaggtcggcttagcctactcgtacttttatcggaagtgtagttgaacttaacctacctaacncgaccacttcgttactaggaaccggaccgaacggtcctacccgtacccgttacgaaaccggaaccgggaaccgaaccccgtaaaacccgaaaaaaccggtcgggtttacggtaacccttaaaccgaaccttaaccggaaacccaacgtaccgttacccggaaccccgaaggttaccggaaaccaccgaaccgtacccgtaaactaccgttaaaccttgtaccgttactaccgaaaccggtacgggggtaacgttgggtaaccgggttcggggttacgggtaccggggtaacctttacgggggaccggaccggggttaaacggggtcccggttcccggtttacgggtaccccgttaaacccgggtttccttaaccccggtctaacccgggttccccgtaacccggaaccccgggtaaccggtacccggtaacccgggtttacccgggttacccccttccccggtttaccggggccccccgtttaacccggtcccgggtcccgttttaacccccgggaacgggtcccgtaccccgttacccggttacccggaacggacccggtttaacccggaacgtcccccggggg

SEQ ID NO: 72259 - DNA, 736 bp, Homo sapiens
  misc_feature: GYAE6OF02IL3MF.21.26.C04.1.454.CMB.1.raw
  modified_base (207)..(207): a, c, t, g, unknown or other
  misc_feature (207)..(207): n is a, c, g, or t
  modified_base (467)..(467): a, c, t, g, unknown or other
  misc_feature (467)..(467): n is a, c, g, or t
tcagtcgtcgctcgcacgaccggtgctcgatttagtctagcgactttgggtttggggggaagaggaagactgacggtcctgctgctgaccatccttcatgggtcttgtcccagatcaccttgaaggagtctggtcccacgctggtcgaacccacagagacctcacgctgacctgcaccttctctggttttcactcagtacactgacngtggtgtggctgactcgtcacgacccccggaaggcccggtacgtggtctgactctactattactcggtaatgataggactaaccactacgacgtccctaatccgtctcgggaacgaaccgtacggtcctaccgtaccctaacgaaccgaaacgggaaccctaacccgaacccgtaaaaaaccgtcgggtaccggtaacccttaacgaccgttacgaaccaactaacgtaccggaacccctagtacgactaacgcgaaccncaagttacctagtacgtagaccgtaacgagggtacggtaggtcgggtagggttaggtacgggttaacgtacgggttacgggtaccggtacgggtaacggttcccggttacggtaccgtacccgtccgtacccgtaccgaccgtaccctacccgtaaccgaacccggtccgtaacgtcccgtccgttccccggtaccgtccggtacccgtcgtcccgtaccggtaccggtcgacccgtaccgtaccggacgtacgacgaccgtacccggg

SEQ ID NO: 72260 - DNA, 821 bp, Homo sapiens
  misc_feature: GYAE6OF02FHH3T.21.26.C04.1.454.CMB.1.raw
tcagtcgtcgctcgcacgaccggtgctcgatttagtctagcgactttgggtttggggggaagaggaagactgacgtcctgctgctgaccatcccttcatgggtcttgtcccagatcaccttgaacggagtctggtcccacgctgggtgaaacccacagacgaccctcacgctgacctgccaccttctcttgggttttccactcacgtaccactgcacggtgggtgtgggctggacttccgtcgaccggtcccccccggaaacggccccggagtcggtcttcgctacgttctaattttagtaggtaatgattgaacttaaccactacgacgcccatccacgttggaaccggccgaaggcccttaccaccccgtgaaccgggtaaggaccaacccggaacccaaaaaaccggttggggtacgtaacccctaaacgacccttacggaaaccccgtaaactaccggttacccgggaaccccctaacgggtacgtaaacccgaaccgtacggaccctaaacgaacctttaccctaccgtagttacgaaccgtaacccggaccggggtacggtcgggtcgggttacggggtacggttaccgggaaccgttaccgggtaccggggacccggtacggggttaccgtacccggttgggtaccctaccgggttacctcccgtaccgtaacccgtcccgtaacccgaacccggtaaccgggtacccgtaccgttccccgggtaccttttcccccgacggtcccgtcccgtcggccctaccggtacggaacccgcccgtacccgtaaccggacgaccgtaccgtacacccggg

SEQ ID NO: 72261 - DNA, 914 bp, Homo sapiens
  misc_feature: GYAE6OF02G4D3B.21.26.C04.1.454.CMB.1.raw
tcagtcgtcgctcgcacgaccggtgctcgatttagtctagcgactttgggtttggggggaagaggaagactgacggtcctgctgctgacaatcccttcatgggtcttgtcccagatcaccttgaaggagtctggtcccacgctggtacgaaacccaacgagacgaccctcacgctgacctgctaccttctcttgggttttcactcgacgtaccactgctaggtgggtgtcgggtctaggacgtccgtcgaccggaccccccgggtaaacggccccggtagtcggtcgttagaccacgttactagttttaaggttaggaatttacggaagttacggtaaacctaaaccctaacgtaacccgaccgtaccccttaactccttacgttaaggaccggaaccgacggtccctacccgaacccgtaccgaaccgggaacggtaaccccgaaccccgaaaacccgtaaaaaccggtacgggttaaccggtaaaccctaaccgtaacgttaaccggaacccaaaccgttaccgtaacccggaaccccgtaacggtaccggtaaccaacccgaaccgaacccgtaaacgtaacctaacgttaccgtggtaaccgaccgtaacccgggtaacggacgggttaccggtacgggtttaggggtaacgggttacgggtaaccggttaaccgggcgggggtaaccggtacggggtaccgtttacccgggtccggtaacccttacccggttaccttaacccggtccgtaacccgttcccgacccaacccggggtaacgtacccggtacgtttcccggtacccgttacccccggtgggtccccgttaccgtacccggtcccgtaaccgggtcgaacccccggttgtaaccccggtcggaaaccggtccgtaccgaccggttaacccggg

SEQ ID NO: 72262 - DNA, 649 bp, Homo sapiens
  misc_feature: GYAE6OF02FMTWF.21.26.C04.1.454.CMB.1.raw
  modified_base (543)..(543): a, c, t, g, unknown or other
  misc_feature (543)..(543): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagacgaccctcacgctgacctgcaccttctctgggttttcactcagtaccactgcaggtgggtggtgggctggacgtccgtcaccggccccccggaaaggccccggaggtcggcttcgcactcatttatagaatgatgactaaccactacgagccatctactcgacggaccaggtcctcacctagaacggaacggaccaccgaacccaaaacgtcggtacgtaccctaacgactacgaacccaaacgtactaccggtacccagtacgaacctaccgacgaccgaactactaactactgcgacgaacgtacgggtagtggcgttgggtacggtcggaacgtacggtcgggaccgagggtaccgtcgacgtcgtaccgtctccgttacncgtccacgaaccgacggtcctagtcccggttcctacccgtgcccgtcgtccgccgtaccggaacggtacacccgttaccgccggacgaccgaccgtacgtacccgg

SEQ ID NO: 72263 - DNA, 911 bp, Homo sapiens
  misc_feature: GYAE6OF02HE2FG.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcaccggaccccccggaacggccccggagtcggtcttgccactctatttagtaggatgatgaactaaccactacacgtcccatctcgtcggtacggacccaggcctaccctaacccgtccgaacgggaaacggtaacccgaaccccggaaaacccgaaaaaacccggtcggggtaaccggttaaccctaaaccgtaaccgttaccggaaaccaaacgtaccgtaacccggaacccccgtacgtacggaacctaacaccggtaacccaaccgtaactttaaccgttacctcggttacgacccgtaacgggaaccgggggtaacggttcgggggtaggttacgggggttacggggttaaccggggacggtttaaccgggggttacgggggtaccccggggtaaacgggggtaccggggttaccggttcccggggttaccctaaccccgggtttccgtaaccccgtccggttaaccccggtaccccttaacccccgggaaacccgggttaaaccccggggtacccccgttaccgggtttaccccgggttacccccccgtttacccccgggtcccgggtaccccggttccccccggtacggtccccgtacccgggtacgggacccggtacccccgtacccggtacccggaaacgggtaccggtaccccgaacggtcccccgggg

SEQ ID NO: 72264 - DNA, 877 bp, Homo sapiens
  misc_feature: GYAE6OF02IVEN3.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtacgaaacccacgagacgaccctcacgcctgacctgccacctttcttcgttgggttttccacttcacgtaccacgtgcgtaggtgggtggtcgggtcgtggacgtccgtcgtaccggacccccggaaacggccccggaggtcggcttcgaccgtacttacgtagtttagttacggaatgtaagtcgaactaaccgtacgtaacaccgacctaacgttcctacggtacggtacggaaccgtacgtcccgttacccaaccgtaccgaaaccggtaacggaaaccgaaccccgtaaaacccgaaaaccggtcgggttaacccgtaacccttaaaccgacgtaacccgaacccgtaaaacgtaccggtaaccggaccccgaacgttaacggaaccaacccggaacaacccgaccgtaattaacccgtacgtacggttacgaaccgtaacgggaaccggggtacgtcgggtacggttccggggtgggtaaccgggtaccggtacgggtacgggtaccgggaaacgggttccgttaccgggttaccgtccggtaacccgtccgtccgtaccgtacccgtaccccgtacccgtaacccgggtacccggtacccgtaaccgttccggttacccccgtcccggtacccgggcccgtttcccggaccggtacccgtacccggtaccgtaaccggacccgtcccggaacccgacggaaccgttaccgggacccgtaccccgggg

SEQ ID NO: 72265 - DNA, 697 bp, Homo sapiens
  misc_feature: GYAE6OF02JCJUQ.21.26.C04.1.454.CMB.1.raw
  modified_base (478)..(478): a, c, t, g, unknown or other
  misc_feature (478)..(478): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtcgaaaacccacagagaccctcacgctgacctgcaccttctcttgggttttcactcacgtaccactgcaggtgggtggtgggctgggactccgtcgaccggaccccccggaaacggccccgggagtcggcttgcactctatttagttaggaactgatgaaactaaccactaacacgccatcctactacggaacggtaccgagtcctccacccctacgaacgacgggaaccacccgaaccgaaaaccgtcggtacgtaccctaactaccgtaacgaaccctaacaacgtaccggaaccccgtagtacggaacacgtacgccaacgtatactancgtacacgacgacgggtgtcgggtcgtggggtagtacgggacgtacgggtacgggacggagggtaccgtcggtacggtccacccgttctaccgtacgcctacccgtaccgaccgaacggtccctacggtcccttacccgtcccgtcgggcccgtccgtcgccgtaccggacggacccgtccctaacggtcccggaacgacgtccggtaaccgtcccggg

SEQ ID NO: 72266 - DNA, 817 bp, Homo sapiens
  misc_feature: GYAE6OF02F9L2C.21.26.C04.1.454.CMB.1.raw
  modified_base (599)..(599): a, c, t, g, unknown or other
  misc_feature (599)..(599): n is a, c, g, or t
  modified_base (746)..(746): a, c, t, g, unknown or other
  misc_feature (746)..(746): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctgggtacgaaacccacagacgaccctcaccgctgacctgcaccttctcgttgggtttcactcacgtaccactgcaggtgggtggtggctgggatccgcgaccggaccccccgggaaaggcccccgggtaggtcggtcttcggaccactacttagttttacgttaggggtaatggtaactggtaaacctaaaaccctaacgttaacccggaaccgtaccccctattacccttccggtaacggtaaccggggtaaccccggacgggtacccttccccgaaaccccgttaccgaaaccgggaaaaccgggaacccaaacccggaaaaccctaaaaaccgggtacgggttaccgtaaccctaaactacgtacgaaaccaactacgtaccgaacccctagtaccgaacacgaccgaccaacgtaactactacgtagcgtacgaacggacgggtggtacggnggttcggggtacggtacgggtacgtaccggggtcgggaccggtaacgggtcgttaccggtcggtaacccgtccggttactccctaccgtacgtaccccgaccgaacccgttaccggccctaacggtcccgttcccgttacccccggnggtcccccgtcgtaccgttccccgacgtaccggaccaccgtccgaccgtaacggcccacgtacggtcccgg

SEQ ID NO: 72267 - DNA, 856 bp, Homo sapiens
  misc_feature: GYAE6OF02HY4U7.21.26.C04.1.454.CMB.1.raw
  modified_base (147)..(147): a, c, t, g, unknown or other
  misc_feature (147)..(147): n is a, c, g, or t
  modified_base (223)..(223): a, c, t, g, unknown or other
  misc_feature (223)..(223): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtnaaacccacagagaccctcacgctcgacctgccaccttctcgttgggttttcactcagtaccactgcaggtgggtgngggcgtggactccgtccaccggcccccggaaacggcccgggagtggcttgcaccgttctagtttagttaggatgatgactaaccaactacacgacctaatcctacgtggtacggaccgacggtcctaccgtacccctacgaacggtaaccggaacccgaaccccggaaacccgaaaaacccggtacgggttaaccggtaccccttaaacctaaaccggttaacccgaaacctaaaccgtacgttaccgggaacccccgtacggtaacgggaacccaacaaccggaccctaaccgtaacgtttaaaccctaacgtacgttacccggtaccgtaaacgggaaccggggtaggttcgggtacgggttcggggttacgggtacgggtaacgtaccgggttaaccggggccgggtacggggtaccgtcccggtaggtacccgttaaccgtcccgttactcccgacccgtaccccgtaacccgacccggaaaccgggtcccgtaccgttacccggttttccccgttacccccggtaccgggtccccgtacccggttcccgtacccggttcccgaaccgggacccgtaccgtaacccggttaccggaccgggaccgtacccggacccgtaaccccggggg

SEQ ID NO: 72268 - DNA, 767 bp, Homo sapiens
  misc_feature: GYAE6OF02HJ8YU.21.26.C04.1.454.CMB.1.raw
  modified_base (707)..(707): a, c, t, g, unknown or other
  misc_feature (707)..(707): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacgagagaccctcacgctgacctcgccacttcttcgttgggttttcactcacgtaccactgacgtaggttgggtgtgggctggacgtccgtcgaccggacccccggaacggaccccggagtcggtcttacgctacgtctatttagttaggaatgaagtagaactaaccaacctacgacgccctactcgtcgtcggacgacgtacggcctacctacctcgaacgaacgaccgaaccgaaccgaaaaccggtacggttaccgtaaccgtaaccaaccgtacgaaccaacgtaccgtaccggaacccgtacgtacggaaccaaccgaccgaaccctaactaaccttactacgtcgtcgaaccgtacgggaacggtcgggacggttcggtaggggttacggacggttaaccggttacgggacgggacccggtaggggttaccgttccgggtacggtacccgttaccggtccgtaccgttaccgacccgtccgtaacccggacccgttacccgggaccttaaccgtcccggttcccttacccggcggtccccgtcccncggtaccgtccggaaccgccgtaaccctcccggtacggaaccgtacggccgaacgcccgg

SEQ ID NO: 72269 - DNA, 819 bp, Homo sapiens
  misc_feature: GYAE6OF02FPSZX.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcacttctctagggtttcactcagtaccactgcgagggggtgtgggctaggactccgtcacggaccccccggaaaggccccggtagtcggtcttcgactacgttacattttagttacggaattgacttagaactaaccactacgacgaccctatctctacggacggaccgaggtcctaccgaccctacgaaccggtaacgaccaacccgaaccaaaaaccgcgggttacgtacccgtaaacgccgtacaaccgtaaccagtaccggtacccagtacggaccgaacgacctaccgaactacgtaccctttaacgtacgtacgacgtaaccggaacgggtacgggtacggtcggttaggggtcggtacgggtaccgtaaccgggttcgggtaacggagggtaccggttccggttaccgggtaccgtacccggtttacccgttaccccttaccgggaacccggtccccttaaccggaacccgggttaaccccgggacccgttaaccggtttcccgggtaccccttttcccccggggacggttccccggtaccccgtccgggttaacccccgtacggtaaacccggtccgaacccctacccggggtaccgaaccggaccttacccggaacccgggcggacccccgggg

SEQ ID NO: 72270 - DNA, 764 bp, Homo sapiens
  misc_feature: GYAE6OF02GTSH0.21.26.C04.1.454.CMB.1.raw
tcagtcgtcgctcgcacgaccggtgctcgatttagtctagcgactttgggtttgggggaagaggaagactgacggtcctgctgctgaccatcccttcatgggtcttgtcccagatcaccttgaaggagtctggtcccacgctggtcgaaacccacagagaccctcacgctgacctgcaccttctcgtgggttttcactctagtaccactgcgaggtcgggtggtgggtctgggacgttcccgtacgccggaccccccgggaaagggtcccccggagttcggacttcggcctaccgtactatttacgttaggaatcgatagaacttaacaacttacacgcctacttcctacgtgacggaccgtacggctacccgacccgtaacgaccggaaacgaccctaacccgaaccgtaaaaaccgtcgggtaccgttacccgtaaaccgtactacgaacctaacgaacgtaccggacccgtacgacggtaaccaaccgtacgacccaaacgtcttaaccgtacttacgtacgaccacgggtaaccgggacggtcgggtcgtggggttacggtacggtacgtaccgggtacgggacggacgggtcgttccgggtcgtaccgtccggtccttaccgcccgtaaccgtccgtaaccgtaccgaaccgggcccttacggtccccttaccgtcccgtaccggtcccgtcccgtaccgtaccggtcccgtacggtccgacccgtacccggtagtaccggctacccgacggtacccgg

SEQ ID NO: 72271 - DNA, 629 bp, Homo sapiens
  misc_feature: GYAE6OF02G4UHZ.21.26.C04.1.454.CMB.1.raw
  modified_base (419)..(419): a, c, t, g, unknown or other
  misc_feature (419)..(419): n is a, c, g, or t
  modified_base (449)..(449): a, c, t, g, unknown or other
  misc_feature (449)..(449): n is a, c, g, or t
  modified_base (602)..(602): a, c, t, g, unknown or other
  misc_feature (602)..(602): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtgggctggactccgtcaccggaccccccggaaggccccggagtcggcttgcactctattatggatgatgaactaaccactacacgccctatctcgtaggacggaccgacggcctccacccgtacgaacggaacggaccaacccgaaccaaaaccgacggtacggtacctaaccactacgaaccaacacgtaccgacccancggacacacgaccactactactacgtgacncgacggacgggtagtcggcgtgggtggtacgggtactacgggtcgggacgacggtcgtccgtcggtccaccgtctcctcgcgtccctaccgaaccgaccggtcctacgtcccggttcctccccggtggccccgtcctcgccgtacgacggtcncctaccggtacgagccgacacgtccgg

SEQ ID NO: 72272 - DNA, 783 bp, Homo sapiens
  misc_feature: GYAE6OF02JOX2Y.21.26.C04.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcacttctctgggttttcactcagtaccactgcaggtgggtgtgggctggatccgtcaccgccccccggaaaggccccggagtggcttgcactcatttatggaatgatgataaccactacacgcccatctctagacggaccgagccgtacccacctaccgaacgaacggaccaccgaccaaaaaccgngggtacggtacctaaccactacgaacccaacgacgtaccggacccctaagtaccgggacaaccgtaccggaccctaactaacttacccgtaacgttacggtacgacccgtaacggaaccggggacggtacggtaccggttaggggtacggtacggggttaccgtacggttcggggaccggtaaggggacttcccggttaccggtaccgttacccgtcccgttacccgttaccgaccggtaccccgttacccgaacccggaaccgggttacccccgaccggttttaccccgggttaaccccgttttccccccggtacgggtccccgggttcccccgtacggttcccgtacccggaaccgggtaaccgccccgacccggttacccggaacggtacccggtaccccgacgggtaccccgggg

SEQ ID NO: 72273 - DNA, 872 bp, Homo sapiens
  misc_feature: GYAE6OF02IT7GZ.21.26.C04.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagtctagcgactttgggtttgggggaagaggaagactgacggtcctgctgctgaccatccttcatgggtcttgtcccagatcaccttgaaggagtctggtcccacgctggtacgaaacccacaagacgaccctacacgctcgacctgcctaccttctcgttgggtttccactctagtaccacgtancgtagtcggtggtggacgtggactccgtaccgaccggaccccccgggaaaggtccccgggagtcggtcgttcgaccacttctaatttagtaggtaatagtagtaagtaacttaaccactaaccgacgaccctacgtcttaccgtggaacggaccgtaacggtctacctaccccgtacgaaccggaaacggaaccaacccgaacccgtaaaaaccggtagggtaccgtaacctaaacgtaccttaaccggaaacctaacgaccgttaaccgaacccctagtaaccgaacctaacgaccgtaacccgaacgttaaaccgtaactacggtacggtaccgtacgtaaccgggtaacggggtacggtacgggtaccggtaggggttacgggttacgggtaaaccggtcgggtacggggccgttaaacgggtccggttccggtaccggtaacccgtaccgttcgtacccgtacccgtaccgtaacccgtaccccgaaacggttacccgggaacccgttccgggttaccccggttaccttcccccggttaccgtaccccgtcccggttacccgtacccgttaacccgaaccgggttaacccgtaccccggtaacccggttaccccggaaacggacccctacccggaacccggaacccggg

SEQ ID NO: 72274 - DNA, 676 bp, Homo sapiens
  misc_feature: GYAE6OF02J1LZ8.21.26.C04.1.454.CMB.1.raw
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
  modified_base (399)..(399): a, c, t, g, unknown or other
  misc_feature (399)..(399): n is a, c, g, or t
tcagtcgtcgctcgcacgaccggtgctcgatttagtctagcgactttgggtttgggggaagaggaagactgacggtcctgctgctgaccatcacttcatgggtcttgtcccagatcaccttgaaggagtctggtcccacgctggtcgaaacccacagagaccctcacgctgacctgcaccttctctggtttcactcagtaccactgcaggtggtgtcgggctggactccgtcaccggcccccggaacggcccgagtggcttgacactctattatggatgatcgactaaccgactacacgtcccatctcgnggacgacgacgcctccacctcgaacggtacggaccacccggaaccaaacgtacggtacgtacctaacncgtacgaccaactgcgaccanagaccacacgaccagtaccttaacgcttacgacgactaaccggcggtagtccggaggtggtacggtcgggacttaaccgggtcgggaacctaggggttcctacggttccgaccttaaccgttcgtcccgtacgacgtccccgtaccaacccggtaacggccccgttacgttaccccgggtacccttccccgggaccggtacccgtcccgaggtacccgttacccggagggaacccttccccgaaggtacccgacggttaccgacccgtaacccgggg

SEQ ID NO: 72275 - DNA, 709 bp, Homo sapiens
  misc_feature: GYAE6OF02JG68D.21.26.C04.1.454.CMB.1.raw
  modified_base (299)..(299): a, c, t, g, unknown or other
  misc_feature (299)..(299): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgccccccggaaaggccccggagtggcttgcactctatttatggaatggatgaactaaccactacncgcccatctctggacggaccacggcctccaccctcaacggaacggaccaacccgaaccaaaaaccgcgggttacggtaccctaaccacctacgaacccaacacgtaccggaacccccagtacgggaccaacgaacgacccaacacttaacctactaggtacgacaaccggaacggggtagtcgggcgttcggggtggtacggggaacgtacggttcggggacccgaaggggtaccgttccgtacggtacccgaccgttccgttaccgtccgaccgtccccgtaccgaacccgaacgggtacccgtaccgttccggttcccgttcccccggtcggccccggtccctccgtccgtacccgagggtacccgcccgtacccgtaccggaacggaccgtaccgaccgtacccggg

SEQ ID NO: 72276 - DNA, 678 bp, Homo sapiens
  misc_feature: GYAE6OF02IWAR4.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacgcccccggaaacggcccggagtggcttgcactctatttattggaatggatgataaccactacagccatctctgacggaccaggctccaccctacacgaacggaccaaccgaccaaaaaccaggtacgtacctaacacgtacgaaccaacacgtacggacccatacggacacacgaccacactactaactgtacgacaacggacgggtagtcggcgtggggtacggtacggggaccttacggcgggggacctaaggggacgttcccgtagggtaccctaccggttcccgtcccgttccgaaccgtcccgtaacccgaaccgggaaccggggtccccaacgttcccgggttacccctttacccccggtggtccccggtcccgtcgtcccgtaccggacgggtaccacccgtacccgtccggaacgtaccgacgacccgtaccggg

SEQ ID NO: 72277 - DNA, 718 bp, Homo sapiens
  misc_feature: GYAE6OF02F6PTY.21.26.C04.1.454.CMB.1.raw
  modified_base (680)..(680): a, c, t, g, unknown or other
  misc_feature (680)..(680): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcacctttgaaggagtctggtcccacgctggtgaaacccacagagaccctcacgctgacctgctaccttctcttgggttttcactcacgtaccactgcaggttcgggtggtgggctggactccgtcaccggaccccccggaaaggccccggagtcggcttgcactctatttatggaatgatgataaccactacacgcccatcctgtgacggaccgaggctcccacctcgaacggaacggaccgaacccgaaccgaaaaccgtcggtacgtaccctaaccgacgtacgaaccaacgtacgtaccggaaccctagtacggaacaaccgacgaccaactactaactacgtcgtacgaccaacggtaccgggaggtacggccgttagggggtacgtacggggaccttacggggttacggggaccgtaacgggaccgttccggttacggtcccttaaccggtccgtacctaccggacctcccgtaaccgaaccgggtaacccgccgttaacgtcccgtttaccccgttcccggacggttccccgtcctacggccctaccggaggtacccnccggtaacccgtccggaacgtcgaccgccgacccgggg

SEQ ID NO: 72278 - DNA, 896 bp, Homo sapiens
  misc_feature: GYAE6OF02H6QRO.21.26.C04.1.454.CMB.1.raw
  modified_base (884)..(884): a, c, t, g, unknown or other
  misc_feature (884)..(884): n is a, c, g, or t
tcagtcgtcgctcgcacgaccggtgctcgatttagtctagcgacttttgggtttgggggaagaggaagactgacggtcctgctgctgaccactcccttcatggtcttgtcccagatcacttgaaggagtctggtcccacgcgtggtacgaaacccacagacgaccctcacgctcgacctgcctaccttccttcgttgggttttccactacgtacgtaccctacgtcgcgtaggttgggtcggtgggtcgtcggtactcccgtccgaacccggaccccccgggaaacgggcccggtaggtcggtcgttcgactactacttagtttagtaggtaatacggtagtacgtaacgttaacccaaccgttaacgaaccgtacccctagttcccgtacgtacggaaccggtacccgaccggtaccctaccctaacccgtaccggtaaaccggaaaccgaaacccgaaaccccggaaaaccccgtaaaaaccggtacggttaccgtaaacccgttaaaccgtaacccgtacccggaaaaccctaaccggaaccgtacccggaaccctaacgtaaccggacaaacccgaaccgacctaaacctaacgttacccgtacgtacgtacgacccggaaacggtacggggtacggtacgggttacgggtagggtcggtaaacgggtacgttaacgggtacgggacgggtacgggtaccgtttccgggtactacccggttccgttcccgtaccgtacccggtaaccgtccccgaaccgtaaccgtacccggaccgttaccgttaccccgggttccctacccgggtccggcctaccccggtccgtaccgtacccggaccggtacccgtaccccgtacccggaccgtaccggaccgtaccncgggtaccccgg

SEQ ID NO: 72279 - DNA, 602 bp, Homo sapiens
  misc_feature: GYAE6OF02G7KSV.21.26.C04.1.454.CMB.1.raw
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
  modified_base (412)..(412): a, c, t, g, unknown or other
  misc_feature (412)..(412): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcaggtgggtgtgggctggatccgtcacgccccccggaaaggccccggagtggcttgcactcatttattggaatgatgataaccactacagcccatctctgacggaccagctccacctcaacggagacaccgaccaaaaccnggtcgtaccaacactgaccaacancggaccccagtcgacacacgccaacactacctactgtcnccaacgacgggagtggcgtgggtgtcgggactacggtcgggccgagggacgtcgtcggtcaccgtctcctacgcgtccctccgaaccgacggccctaaccgtccgttcccttccccgtcggcccgtccccgtcgcccgtaccgacggtaccgcccgtaccctccggaaccgacggaccgacgtacccggg

SEQ ID NO: 72280 - DNA, 819 bp, Homo sapiens
  misc_feature: GYAE6OF02IPYNO.21.26.C04.1.454.CMB.1.raw
tcagtcgtcgctcgcacgaccggtgctcgatttagtctagcgactttggggtttgggggggaagaggaagactgacggtcctgctgctgaccatcccttcatgggtcttgtcccagatcaccttaggaaaggagtccgtcggtcccacgcgttgggtacgaaacccacaggaacgaccctcaccgcgtgaaccgtcgcctacctttctcgtttcgggttttccacttcaacgtaccactcgacggtaggtgggggttacgggtggggtcgtacgggtacgtccccggtccggaacccccgggacccccggggaaaaccggggccccggggtagggtccgggtccttcgactaccgttcgttaagtttttacggaaggtaagtacgtagttaacgtaactaaacccactaacgaccgtaccctatcgttacggacgacggaacgcggtacctaccggacctacaacgggaacgaccaaccgtaaaccgaaaccgtggtaaccgtaaccgtacacgacgaaccaactaccggaccggtacccaagggacctaaccgaataccgacaactactacgtacgcgacgacaacgggcggtacggaggtcggttagggtacggtacggcggttacgggacggtacgggacggttcgtaccggtcggtccgtacgttccgtacgtcctaccgaccctaccggaccggtaccgggaccgtaccggtaccggttccccggtaccgccggtccggttacccgtcggtacccggtaacgaacccggtaccgacgttaccggaaccggtacgtaccgaacgccggtacccgg

SEQ ID NO: 72281 - DNA, 637 bp, Homo sapiens
  misc_feature: GYAE6OF02GSX7L.21.26.C04.1.454.CMB.1.raw
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (519)..(519): a, c, t, g, unknown or other
  misc_feature (519)..(519): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggactccgtcaccggcccccggaaaggccccggagtggcttgcactctatttatggaatgatgactaaccactacncgcccatctctgacggaccgaggctcaccctacacggaacggaccaacccgaacccaaaaaccgnggttacgtacctaaacgacgtacgacccaacacgtacggaccccagtcggacacgacgccaacactactactgacgacaacgacgggagtcggcgtgggtagtcggacgtacggtcgggccagggcgtccgtggtccacccgtctaccgtacgcncccgtaccaccgtaaccggcctacgttcccggtcccttccccggcggaccccgtcccgttcacccgtccggacggacgacccgtacccgtcccggaagccggtaccgtacgacccggg

SEQ ID NO: 72282 - DNA, 875 bp, Homo sapiens
  misc_feature: GYAE6OF02JH9QK.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctgacctgcaccttctctgggttttcactcagtaccacgtgcaggtgggtggtgggctggatccgacgacggacccccggaaaggccccggaggtggacttcgcactctatttagttggaatgatagaactaaccaactacgacgtccctaatcctcgtacggaacggtacccgagggtaccctccgtaccccgttacgaaccggaacggtaaccccaaacccggtaacccaaaaaacccggttacggggtaccgttaaaccccgtaaaccgaccgttaccggaaacccgaaaccgtacgttacccgggtaaccccccgtaaggttaccgggaacctaaccggaaccgtaccctaacgtaacgtaccttaacgtacgtcgaaccgacggtacggggtaagtcgggtacgtcggggttacggtacggggtaaccgtcgggtacggggtacccggtaaacgggtcgtttcccgttacgggtacccgtacccgttccgttacccgttaccgtaccgttaccccgttaaccgaacccgggttaaaccggccccgttaacgggtttacccggtaccccgttttaccccgggcccgggtacccgtccccgggtttaactcccgttaaccccgggtaacggggtacccgtaaccccggttaccccggtaacccggtaacgggacccggtacccaacccgggttaaccccgggg

SEQ ID NO: 72283 - DNA, 732 bp, Homo sapiens
  misc_feature: GYAE6OF02JG0Y9.21.26.C04.1.454.CMB.1.raw
  modified_base (281)..(281): a, c, t, g, unknown or other
  misc_feature (281)..(281): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctggtttcactcagtaccactgcagtgggtgtgggctggatccgtcacgaccccccggaaggccccggagtggcttgcactcatttagtgaatgatnaactaaccactacacgccccatacctcgtaggacggacctaggaccttccaaccctcgaacggaacggaaccgtacccgaaccaaaaaccggaggttccggtaccttaacacgtacgaaccaacagtaccggtaccccaagtacggaaccacgtaacctaccgaaacctataacgtacgtacgttacgacgaaccgacgggaaggtcgggtcgttcgggttacggtacgggtaaccgttacgggttacggggccgtacggggtacgtaccggtcgtaccgtacccgttcgttacccgtccgtacgtacccgtacccgacccgtaaccgggacccgtaccgtccggttaccccttaccccgtaccgggtccgtccccggttctcccgtacccggacggtacggacccgttacccgtacccggaaccgtaccggaccggaacccggacccggg

SEQ ID NO: 72284 - DNA, 718 bp, Homo sapiens
  misc_feature: GYAE6OF02I9BW9.21.26.C04.1.454.CMB.1.raw
  modified_base (291)..(291): a, c, t, g, unknown or other
  misc_feature (291)..(291): n is a, c, g, or t
  modified_base (424)..(424): a, c, t, g, unknown or other
  misc_feature (424)..(424): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctggttttcactcagtaccactgcagtgggtgtgggctggatccgtcacgcccccggaaggcccgagtgctgcactcatttatggatgatagactaaccactacgngcccatctctggacggaccacggcctaccgaccctagaaccgaacggtaccaacccgaaccgaaaaccgcggttacgtaccaactacgtacgaacctaaacgcgtaccgaaccctagtacggaactaacgacncccgtaactaacgttacctagtcgtaccgtaccgaccgtaacgggtcggacggtccggttagggtacggtacgggaaccgttacggtcggggacccggtacggggtccgttacccggttcggtacccgtacccgtccgttacccgtacgaccggttcccgtaaccccgaacggtaacccgggtccctaacggttcccggttccccgtttcccgggtcggaccccgtcccgttaccgccgttaacccggacggtccgaccgtaccggtacccgaaggcccgtaccaccggtccgg

SEQ ID NO: 72285 - DNA, 684 bp, Homo sapiens
  misc_feature: GYAE6OF02FMB3M.21.26.C04.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagacgaccctcacgctgacctgcaccttctctgggttttcactcacgtaccactgcagtgggtgtggcgtggactccgtcgaccggacccccggaaggccccggagtcgcttgactactctatttagtagatagtagtagtaactaaccactacgacgtacctatcgtacgtacggacggaccncgtcctaccacctacgaacggaacgaccgaaccgaaaccgaaacgtacggtacgtacctaacacgtacgaaccaactacgtaccgaccctagtacgacaccgacgacctactaactacgtacgtcgacgaccgacggtacggtaggtcggtacggttcgggtacggtacggtacgtcgggacgggtacgacggtacgtaccgtcggtaccgtaccgttaccgacgtaccgtaccgtcccgtaccgacgtaccgtccttacgtcccgttcccgtcccgcgtacccgtccgtcgtcccgaccgtcggaccgacccgtaccgtaccggacgaccgtaccgacggccgg

SEQ ID NO: 72286 - DNA, 740 bp, Homo sapiens
  misc_feature: GYAE6OF02HOVGN.21.26.C04.1.454.CMB.1.raw
  modified_base (664)..(664): a, c, t, g, unknown or other
  misc_feature (664)..(664): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgcctaccttcttcgttgggttttcactcacgtaccactgcaggtgggtgtgggcgtcggactccgtccaccggaccccccgggaaacggtcccggagtcggcttcgcactctatttagtagatcgatagactaaccactacacgtaccatcctcgtgacggaccacggtcctaccaccgtcgaaccggacgaaccacccgaaaccgaaaaccgtcggtaacggtaccctaaacgacctacgaaccaacgaacgtcccgaacccagtaccgaacaccgtacacactactaacttcgcgtacgacgaccggagggacggttcgggtggttcgggtcggtacgggtacggtacggttccggggacgtacgggttcgttccggtacggtcctaccggtccgtacccgtacgaccgtacccgtacgaacccgtaaccgggcctaccgggttcccgtcccggtttaccccggcggttccccggccggttacccncccgggttaaccgggaccggtaccgtacccgtaacctacccggggtacgtaccggaccggtaacccgggtcccggg

SEQ ID NO: 72287 - DNA, 716 bp, Homo sapiens
  misc_feature: GYAE6OF02GJNBQ.21.26.C04.1.454.CMB.1.raw
  modified_base (298)..(298): a, c, t, g, unknown or other
  misc_feature (298)..(298): n is a, c, g, or t
  modified_base (416)..(416): a, c, t, g, unknown or other
  misc_feature (416)..(416): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgctaccttctctgggttttcactcacgtaccactgcagtgggtgtgggctggatccgtcacggacccccggaaggcccggagtggctgcactctatttatgaatgatgaactaaccactaacncgtaccactctctacggacgaccagcctaccacctacaacggaacgaccaaccgaaccaaaaccgtggtacgacctaacactacgaaccaacgcgtacggaccctacgtacgacaacncgaccaactacgtacactggtacacgaacgacgggtacgtcgggtacgtggggtacggtacggacggttacggtgggacccggttaggacgtaccggtaccggttaccaccggtttcctaccggttacaccgttcccttacccgacgtaacccgggtacgtaccgttaccgggttaccctttcccccggacggttccccgtcccggtacccggtcccgtttaacccgggaacgggtacccgtaaccccgtaccggttaacccggtaccggaaccgggttaccccaacgggtaccccgggg

SEQ ID NO: 72288 - DNA, 746 bp, Homo sapiens
  misc_feature: GYAE6OF02FMKF8.21.26.C04.1.454.CMB.1.raw
  modified_base (434)..(434): a, c, t, g, unknown or other
  misc_feature (434)..(434): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacacgacgaccctcacgctgacctgcaccttctcttgggttttcactcagtaccactgctagtgggtgtgggctggatccgtcacggacccccggaaaggccccggagtggcttcgcactcaagttttacttggaacttgaatgaagtaccattaccaagtacccatcctactagagtaacccaggtctcccaacctcgaacgaacggaaccaccgaacaaaaccgtagggtacgtacctaaactcgactaaccgaacacttcggaacccagtgaacctanacgacctactaactaccttacgtcgtagtaccgtaacacgggagttacggacgttacggggtacggttaaccgggaacgttaaccggtcggggaacccgaacgggggttacgtacccggttacggtccgaaccgttccgttacccttaccgtccggtaccttaacccggacccgaaacggggtaccccctaagttcccggtttaccgtttaccccgttccgggccgttaaccccgtggtaaccccgttccggtaaggaaccgtaccaaccccgggttacggtaacccggaacttccggtaacgaccccgggg

SEQ ID NO: 72289 - DNA, 768 bp, Homo sapiens
  misc_feature: GYAE6OF02IPLDU.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggttttcactcagtaccactgcagtgggtgtggctggactccgtcacggaccccccggaaggccccggagtcgcttgcactctatttattgaatgatcgactaaccactacacgcccatcctcgtacggacggaccgacggcctaccgaccctaccgaaccggaaacggaccgaacccgaacccaaaaaccgtcggttaccggtaccgtaaaccaactacgaaaccaacctaacgtccggtaaccccgagtacggaaccaacgaccgaccaactacgtaacctacgtacgtaaccgacgaaccgggacggggtacgtccgggtacggttcgggggtaggtaccggggtaccgttaccgggtacgggaccgggtacgggtaccgttccgtaccggtaccgtaccgtccgttacccgtcgaaccgtccctaccgaaccggtaaccggcccgtaacgttccccgggtttcccttcccccgtcgggtcccccgtcccgttaccggtacccgttacccggaccgggtaacccgtcccggtaacccggtacccggtaacggaccggtacccaccgggtaccccggg

SEQ ID NO: 72290 - DNA, 759 bp, Homo sapiens
  misc_feature: GYAE6OF02HGTHS.21.26.C04.1.454.CMB.1.raw
  modified_base (156)..(156): a, c, t, g, unknown or other
  misc_feature (156)..(156): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccanagacgaccctcacgctgacctgcaccttctctggtttcactcacgtaccactgcagtgggtgtcgggctggactccggtcaccggacccccggaaggccccggagtggcttgccactctacgtttatcggtaatcgagtgtaactaaccactacgacgtcccattctaccgtcggacggtacccaggtcgtcccaccgtaccgaacgaacgaccaacccgaaccaaaaaccgtggtaccgtaccaacaccgtacgaaccaacgtaactaccgggaaccccctaaggtcgtaacccgtaacgaccaccgtaacctaaccgtaccttaacgtacgttacgaccgtacggacgggtacggtcggtcggtacgggtggtacgggtacgtacggtacggggaccggtacggtacgtcccgtcggttacccgacggttcccgtaccgtccgtaacgttcccgtaacccgtacccgaacccgggtccaccgggtttacccgtaccccgttccccggtcggtacccggcccggttaccgcccgtaccggtaaccggtaccgtacccgtacccgtaccccgggtaacgacccggtaccaaccggtacccggg

SEQ ID NO: 72291 - DNA, 721 bp, Homo sapiens
  misc_feature: GYAE6OF02FVYYI.21.26.C04.1.454.CMB.1.raw
  modified_base (370)..(370): a, c, t, g, unknown or other
  misc_feature (370)..(370): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcgagtgggtgtgggctggactccgtcacggacccccggaaggccccggagtggcttgcactcatttagttggaactgatgaacttaaccactaacagcccatcctctaggaggaccgaggcctccaccctactacgaacggacaaccgaccctaaaaaccgngggtacgtaccgtaaacaccgtacgaaccaacgtaataccgggaacccctaggtacggaaccacctacggaaccctaactacgttaacctacgtcgttacgccggaaccgacggggtacggtacgggacggtttcggggtagggttaccgggaccgttacgggccggggtaccgaacgggggttcgtcccgttcgggtcccgtaaccggtcctaccgttcgaccgcccgttacccaacccgtaacggcccgtacgtaccggttcccgttaccccgcggtaccccggccgttccgacccgtccacggtacccgaccggtaccttcccgggaactcgaccgaccgtacccggg

SEQ ID NO: 72292 - DNA, 877 bp, Homo sapiens
  misc_feature: GYAE6OF02JGP4J.21.26.C04.1.454.CMB.1.raw
  modified_base (179)..(179): a, c, t, g, unknown or other
  misc_feature (179)..(179): n is a, c, g, or t
  modified_base (191)..(191): a, c, t, g, unknown or other
  misc_feature (191)..(191): n is a, c, g, or t
  modified_base (289)..(289): a, c, t, g, unknown or other
  misc_feature (289)..(289): n is a, c, g, or t
  modified_base (410)..(410): a, c, t, g, unknown or other
  misc_feature (410)..(410): n is a, c, g, or t
  modified_base (495)..(495): a, c, t, g, unknown or other
  misc_feature (495)..(495): n is a, c, g, or t
tcagtcgtcgctcgcacgaccggtgctcgatttagtctagcgactttgggtttgggggaagaggaagactgacggtcctgctgctgaccatccttcatgggtcttgtcccagatcacttgagagtctggtcccagctggtacgaaacccacagagaccctcacgctgacctgcaccttntctgggtttacnctcagtaccactcgctagtgggtgtagggccttggactccgtacacggacccccccgggaaaggccccggagtcgggccttagcctactgaacgtttnttaggaatcggattggaactaaccgacctaagccgacccctattcctcgtacgtacggaccctaggccttcgacccttacgacggaaacggtaccgaacccgtaacccgtaaaaaacccgnggggttaccggtaccctaaacgtaaccgttcggaaccctaaactacgttaacccgggacccctacggtaccggaacaccgtaacncccgtaaccgaatttaccgagttacggacgtaccggaaccgaacggggtacgtcgggtaccgttaggggttaccgggtcgggtacctacgggttacggggccgtaacggggtacgttcccggttgggaacccctaccggttaccctacccggtacccggtacgtaccccggtacccggtaaacccggtaacccggggttacccgaacccggttttccccggggtaaccggtttttaccccccccgtaagggggtcccccccggttaaaccccggtttccgggaacccgtttacccccggaacgggtaccccgttacccgtaaaccccgggtccccgggttaaccgggacccggttaccggttaaccccgggacccccggggg
